(12) United States Patent
Morales et al.

(10) Patent No.: US 11,654,166 B2
(45) Date of Patent: *May 23, 2023

(54) **THERAPEUTIC BACTERIOPHAGE COMPOSITIONS FOR TREATING *STAPHYLOCOCCUS* INFECTION**

(71) Applicant: Armata Pharmaceuticals, Inc., Marina del Rey, CA (US)

(72) Inventors: Sandra P. Morales, Sydney (AU); Gillian Mearns, Sydney (AU); Deborah A. Rankin, Sydney (AU); Frenk Smrekar, Ljubjlana (SI)

(73) Assignee: ARMATA PHARMACEUTICALS, INC., Marina del Rey, CA (US)

( * ) Notice: Subject to any disclaimer, the term of this patent is extended or adjusted under 35 U.S.C. 154(b) by 199 days.

This patent is subject to a terminal disclaimer.

(21) Appl. No.: 16/959,666

(22) PCT Filed: Jan. 2, 2019

(86) PCT No.: PCT/US2019/012114
§ 371 (c)(1),
(2) Date: Jul. 1, 2020

(87) PCT Pub. No.: WO2019/136109
PCT Pub. Date: Jul. 11, 2019

(65) Prior Publication Data
US 2021/0077551 A1    Mar. 18, 2021

Related U.S. Application Data

(60) Provisional application No. 62/731,775, filed on Sep. 14, 2018, provisional application No. 62/678,611, filed on May 31, 2018, provisional application No. 62/613,050, filed on Jan. 2, 2018.

(51) Int. Cl.
| | | |
|---|---|---|
| A61K 35/76 | (2015.01) | |
| A61P 31/14 | (2006.01) | |
| A61K 9/00 | (2006.01) | |
| A61K 45/06 | (2006.01) | |

(52) U.S. Cl.
CPC ............ *A61K 35/76* (2013.01); *A61K 9/0019* (2013.01); *A61P 31/14* (2018.01); *A61K 45/06* (2013.01)

(58) Field of Classification Search
None
See application file for complete search history.

(56) References Cited

U.S. PATENT DOCUMENTS

| | | |
|---|---|---|
| 8,388,946 B2 | 3/2013 | Soothill et al. |
| 8,475,787 B2 | 7/2013 | Harper |
| 9,623,058 B2 | 4/2017 | Jia |
| 10,517,908 B2 | 12/2019 | Shaw et al. |
| 11,253,557 B2 | 2/2022 | Shaw et al. |
| 2011/0182863 A1* | 7/2011 | Jia .......................... A61L 15/46 424/93.6 |
| 2015/0216179 A1 | 8/2015 | Jia |
| 2017/0065649 A1 | 3/2017 | Shaw |
| 2018/0289756 A1 | 10/2018 | Harper et al. |
| 2019/0359947 A1 | 11/2019 | Shaw et al. |
| 2020/0171108 A1 | 6/2020 | Shaw et al. |

FOREIGN PATENT DOCUMENTS

| | | |
|---|---|---|
| JP | 2007259856 A | 10/2007 |
| JP | 2015512384 A | 4/2015 |
| JP | 2020520980 A | 7/2020 |
| WO | 9603649 A1 | 2/1996 |
| WO | WO 2005009451 | 2/2005 |
| WO | WO 2008110840 | 9/2008 |
| WO | WO 2009044163 | 4/2009 |
| WO | 2013141730 A1 | 9/2013 |
| WO | WO 2013164640 | 11/2013 |
| WO | 2016066722 A2 | 5/2016 |
| WO | 2017015652 A1 | 1/2017 |
| WO | WO 2018146437 | 8/2018 |

OTHER PUBLICATIONS

International Search Report and Written Opinion received for PCT Application No. PCT/GB2017/050376, dated Sep. 15, 2017, 12 pages.
Trial Registered on ANZCTR, Australian New Zealand Clinical Trials Registry, 7 pages, last updated Dec. 14, 2016, retrieved Feb. 3, 2021.
Magiorakos et al. (Mar. 2012) "Multidrug-Resistant, Extensively Drug-Resistant and Pandrug-Resistant Bacteria: An International Expert Proposal For Interim Standard Definitions for Acquired Resistance", Clinical Microbiology and Infection, 18(3):268-281.
World Health Organization (Jan. 9, 2017) "International Clinical Trials Registry Platform, A phase 1 investigator initialed study to evaluate the safety, tolerability and preliminary effectiveness of AB-SA01 in patients with chronic rhinosinusitis associated with *Staphylococcus aureus* infection", 2 pages.
AmpliPhi Biosciences Corporation, AmpliPhi Biosciences reports favorable final results from Phase 1 Trial of AB-SA01 in chronic rhinosinusitis, 2016, 5 pages.
Baker et al., Protein Structure Predication and Structural Genomics, Science, 2001, pp. 93-96, vol. 294, No. 5540.
Barr, et al., Value of charcoal media for recovering staphylococci incorporated in mupirocin ointment, Journal of clinical pathology, 1987, pp. 372-376, vol. 40, No. 4.
Bautz, Aphb: Early signs of efficacy seen in Phase 1 Trial of AB-SA01 in chronic rhinosinusitis, 2016, 4 pages.

(Continued)

*Primary Examiner* — Michelle F. Paguio Frising
*Assistant Examiner* — Grant C Currens
(74) *Attorney, Agent, or Firm* — Mintz, Levin, Cohn, Ferris, Glovsky and Popeo, P.C.

(57) ABSTRACT

The present disclosure relates to a bacteriophage composition comprising one or more (suitably two or more, or three) obligately lytic bacteriophages capable of infecting and lysing *Staphylococcus aureus*, and use of the same for treating *Staphylococcus aureus* bacterial infections.

34 Claims, 4 Drawing Sheets
Specification includes a Sequence Listing.

(56) References Cited

OTHER PUBLICATIONS

Bautz, et al., Safety of AB-SA01 firmly established following Phase 1 Trials, 2016, 3 pages.
Carlson, Appendix: Working with Bacteriophages: and Methodological Approaches, 58 pages, 2005 CRC Press.
Darling, et al., Mauve: Multiple Alignment of Conserved Genomic Sequence With Rearrangements, Genome Res., 2004, pp. 1394-1403, vol. 14, No. 7.
Hyman, et al., Practical methods for determining phage growth parameters, Bacteriophages. Humana Press, 2009, pp. 175-202.
Kelly, et al., Development of a broad-host-range phage cocktail for biocontrol, Bioengineered bugs 2.1, 2011, pp. 31-37.
Lehman, et al., Design and Preclinical Development of a Phage Product for the Treatment of Antibiotic-Resistant *Staphylococcus aureus* Infections, Viruses, 2019, 16 pages, vol. 11, No. 88.
Ooi, et al., A Phase 1 investigator initiated study to evaluate the safety, tolerability, and preliminary effectiveness of AB-SA01 in patients with chronic rhinosinusitis associated with *Staphylococcus aureus* infection, Internnationa; clinical trials registry platform, 2016, 3 pages.
Otter, et al., Molecular epidemiology of community-associated meticillin-resistant *Staphylococcus aureus* in Europe, Lancet, 2010, pp. 227-239, vol. 10, No. 4.
Shaw, et al., Efficacy of a bacteriophage cocktail in a *Staphylococcus aureus* mouse pneumonia model is comparable to Vancomycin, 2017, 1 page.
Thompson, et al., improving the sensitivity of progressive multiple sequence alignment through sequence weighting, position-specific gap penalties and weight matrix choice, Nucleic acids research, 1994, pp. 4673-4680.
Van Walle, et al., Align-m-a new algorithm for multiple alignment of highly divergent sequences, Bioinformatics 2004, pp. 1428-1435.
Zhang, et al., Bacteriophage effectively kills multidrug resistant *Staphylococcus aureus* clinical isolates from chronic rhinosinusitis patients, Int Forum Allergy Rhinol, 2018, pp. 406-414, vol. 8, No. 3.
Attwood, Teresa K. (Oct. 27, 2000) "The Babel of Bioinformatics", Science, 290(5491):471-473.
Kirby, Amy E. (Nov. 2012) "Synergistic Action of Gentamicin and Bacteriophage in a Continuous Culture Population of *Staphylococcus aureus*", PLoS One, 7(11):e51017(9 pages).
Ali et al. (2015) "Efficacy of Bacteriophage-Antibiotic Combinations against *Staphylococcus aureus* Infections: In vitro Study", International Journal of Pharmaceutical Sciences Review and Research, 34(1):186-189.
Alves et al. (Nov. 2014) "Combined use of Bacteriophage K and a Novel Bacteriophage to Reduce *Staphylococcus aureus* Biofilm", Applied and Environmental Microbiology, 80(21):6694-6703.
Drilling et al. (Jan.-Feb. 2014) "Bacteriophage Reduces Biofilm of *Staphylococcus aureus* Ex Vivo Isolates from Chronic Rhinosinusitis Patients", American Journal of Rhinology & Allergy, 28(1):3-11.
Ryan et al. (2011) "Recent Advances in Bacteriophage Therapy: How Delivery Routes, Formulation, Concentration and Timing Influence the Success of Phage Therapy", Journal of Pharmacy and Pharmacology, 63:1253-1264.

\* cited by examiner

FIG. 4

| | Sa83 | Sa87 | J-Sa36 | Sa38 | Sa41 | Sa42 | Sa44 | Sa51 | Sa76 | Sa81 | J-Sa37 |
|---|---|---|---|---|---|---|---|---|---|---|---|
| Sa83 | 100% (0%) | 96.7% (3.1%) | 96.0% (2.9%) | 97.9% (2.0%) | 99.8% (0.2%) | 99.9% (0.1%) | 97.7% (2.2%) | 97.9% (2.0%) | 97.4% (2.5%) | 97.9% (2.0%) | very low |
| Sa87 | | 100% (0%) | 93.3% (5.3%) | 94.9% (4.9%) | 96.7% (3.1%) | 96.8% (3.9%) | 94.7% (5.1%) | 94.9% (4.9%) | 94.4% (5.4%) | 94.9% (4.9%) | very low |
| J-Sa36 | | | 100% (0%) | 94.2% (4.7%) | 95.9% (3.0%) | 96.0% (2.9%) | 94.2% (4.9%) | 94.2% (4.7%) | 93.8% (5.2%) | 94.2% (4.7%) | very low |
| Sa38 | | | | 100% (0%) | 97.9% (2.0%) | 98.0% (2.0%) | 99.7% (0.3%) | 99.9% (0.0%) | 99.4% (0.6%) | 99.9% (0.1%) | very low |
| Sa41 | | | | | 100% (0%) | 99.8% (0.1%) | 97.7% (2.3%) | 97.9% (2.0%) | 97.4% (2.5%) | 97.9% (2.0%) | very low |
| Sa42 | | | | | | 100% (0%) | 96.8% (2.2%) | 98.0% (2.0%) | 97.5% (2.5%) | 98.0% (2.0%) | very low |
| Sa44 | | | | | | | 100% (0%) | 99.6% (0.3%) | 99.1% (0.9%) | 99.7% (0.3%) | very low |
| Sa51 | | | | | | | | 100% (0%) | 99.4% (0.6%) | 100.0% (0.0%) | very low |
| Sa76 | | | | | | | | | 100% (0%) | 99.4% (0.6%) | very low |
| Sa81 | | | | | | | | | | 100% (0%) | very low |
| J-Sa37 | | | | | | | | | | | 100% (0%) |

THERAPEUTIC BACTERIOPHAGE COMPOSITIONS FOR TREATING *STAPHYLOCOCCUS* INFECTION

CROSS REFERENCED APPLICATIONS

This application claims priority to U.S. Provisional Application No. 62/613,050 filed Jan. 2, 2018, U.S. Provisional Application No. 62/678,611 filed May 31, 2018, and U.S. Provisional Application No. 62/731,775 filed Sep. 14, 2018, the entirety of which is incorporated by reference herein.

SEQUENCE LISTING

The instant application contains a Sequence Listing, which has been submitted electronically in ASCII format and is hereby incorporated by reference in its entirety. Said ASCII copy, created on Jan. 2, 2019 is named 054249-502001WO_Sequence_Listing_ST25 and is 1,852,409 bytes in size.

BACKGROUND

Described herein are bacteriophage, compositions of bacteriophage, and use of the same for medical and non-medical applications.

The increasing number of human pathogens that are resistant to antibiotics has created an urgent need for new treatments for serious bacterial infections. Novel approaches that circumvent traditional mechanisms of antibiotic resistance, can be effective against biofilms, and avoid disruption of the native gut flora are especially desirable. This clinical challenge has sparked renewed interest in bacteriophage (phage) therapy.

SUMMARY

Provided herein are bacteriophage, including non-naturally occurring bacteriophage, bacteriophage compositions. The compositions can be substantially free of bacterial components such as bacterial endotoxin and host cell components (e.g., protein). The compositions can include one or more obligately lytic bacteriophages and optionally a cryoprotectant or other excipient. In some aspects, the bacteriophage includes a nucleic acid sequence, or has a genome that can include a nucleotide sequence, having at least 93% identity to any one of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, or SEQ ID NO: 10. In some embodiments the sequence does not have 100% sequence identity to one or more SEQ ID NOS: 1-10. In some cases, each individual bacteriophage is not prone to generalized transduction and/or does not carry antibiotic resistance genes. In some embodiments, one or more of the bacteriophage are not naturally occurring.

In an aspect, provided herein are bacteriophage compositions substantially free of bacterial components such as bacterial endotoxin, bacterial host protein, and the like. In some embodiments, provided herein are bacteriophage compositions that include one or more obligately lytic bacteriophages capable of complementation. The bacteriophage can include a nucleic acid, or a genome, including a nucleotide sequence having at least 93% identity to any one of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, or SEQ ID NO: 10, and optionally a cryoprotectant, In some embodiments the nucleotide sequence is not 100% identical to at least one of SEQ ID NO: 1, SEQ ID NO: 2, SEQ ID NO: 3 SEQ ID NO: 4, SEQ ID NO: 5, SEQ ID NO: 6, SEQ ID NO: 7, SEQ ID NO: 8, SEQ ID NO: 9, or SEQ ID NO: 10. In some embodiments, the composition's target bacteria range is broader than the range of any individual bacteriophage in the composition or the sum of the individual bacteriophage in the composition. In some embodiments, one or more of the bacteriophage in the compositions are not naturally occurring.

In an aspect, provided herein are bacteriophage compositions. The compositions can be substantially free of bacterial components, such as bacterial endotoxin, bacterial host protein, and the like. The compositions can include at least one obligately lytic bacteriophage. In some embodiments, the composition includes a storage media for storage at a temperature selected at or below 8° C. Any bacteriophage in the composition may include a nucleic acid, or have a genome, including a nucleotide sequence having at least 93% identity to one or more of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, or SEQ ID NO: 10. In some embodiments at least one bacteriophage nucleic acid or genome does not have 100% identity to any one of SEQ ID NOS: 1-10. At least one of the individual bacteriophage is not prone to generalized transduction and/or does not carry antibiotic resistance genes. In some embodiments, one or more of the bacteriophage of the compositions are not naturally occurring.

In another aspect, there is provided a bacteriophage composition for use as a medicament, or for use in the treatment of a bacterial illness associated with *S. aureus*. Any of the compositions provided herein are contemplated for use in the treatment of a disease or illness such as a *S. aureus* infection. In some embodiments, one or more of the bacteriophage are not naturally occurring. Corresponding methods of treating a disease comprising administration of the bacteriophage composition to a subject are also provided.

In an aspect, provided herein are methods of treating a human with a bacterial infection including administration to the human a composition including one or more distinct bacteriophages that infect and lyse *Staphylococcus aureus* bacteria. At least one of the bacteriophage can have a nucleic acid or a genome, including a polynucleotide sequence selected from one or more of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, or a sequence having at least 93% identity to any one of SEQ ID NOS: 1-10. In some aspects one or more of the bacteriophage are not naturally occurring. The methods can include selecting a patient with a *S. aureus* infection. In some aspects, the infection is non-pulmonary.

In an aspect, provided herein are methods of treating a human with a confirmed non-pulmonary *S. aureus* infection including administration to the human of a composition including one or more distinct bacteriophage that infect and lyse *Staphylococcus aureus*. At least one of the bacteriophage include a nucleic acid a genome, comprising a nucleotide sequence selected from one or more of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, or a sequence having at least 93% identity to any one of SEQ ID NOS: 1-10. In some aspects, the infection is not a pulmonary *S. aureus* infection. In some aspects one or more of the bacteriophage are not naturally occurring. The methods can include selecting a patient with a *S. aureus* infection. In some aspects, the infection is non-pulmonary.

In an aspect, provided herein are methods of modifying the microbial flora in a human including administering to said human a composition including one or more distinct bacteriophages having lytic activity against *Staphylococcus aureus*. The one or more distinct bacteriophages are selected from bacteriophages having nucleic acid or a genome, including a nucleotide sequence of any one of SEQ ID NO: 1, SEQ ID NO:2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, or a sequence having at least 93% identity to any one of SEQ ID NOS: 1-10. In some aspects one or more of the bacteriophage are not naturally occurring. The methods can include selecting a patient with a *S. aureus* infection. In some aspects, the infection is non-pulmonary.

A further aspect relates to, for example, a bacteriophage composition for use in treating a bacterial infection in a subject, wherein the bacteriophage composition is administered to the subject, and wherein the bacterial infection includes *Staphylococcus* (e.g., *Staphylococcus aureus*) infections.

Some aspects relate to, for example, use of a bacteriophage composition in the manufacture of a medicament for use in treating a bacterial infection in a subject, wherein the bacteriophage composition is administered to the subject, and wherein the bacterial infection comprises *Staphylococcus* (e.g., *Staphylococcus aureus*).

Some aspects relate to a bacteriophage. For example, a bacteriophage designated herein as Sa87, J-Sa36, Sa83, Sa38, Sa41, Sa42, Sa44, Sa51, Sa76, and Sa81. Also, a bacteriophage having 90-100% nucleic acid sequence identity to any of the same and/or to one or more of SEQ ID NOs: 1-10.

Some aspects relate to uses of any bacteriophage or composition described herein in the treatment of a *Staphylococcus aureus* infection in a human, wherein the infection is substantially or completely non-pulmonary. The use can include administering the composition to a human suffering from a *S. aureus* infection.

Some aspects relate to uses of any bacteriophage or composition described herein in the treatment of a *Staphylococcus aureus* infection in a human. The uses can include, for example, administering a composition of one or more distinct bacteriophages to said human; wherein at least one of said one or more bacteriophage comprises a genome comprising a polynucleotide sequence selected from the group consisting of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, and a sequence having at least 93% identity to any one of SEQ ID NOS: 1-10. In some uses, the one more of the bacteriophage are not naturally occurring.

Some aspects relate to uses of any bacteriophage or composition described herein in the treatment of a confirmed non-pulmonary *Staphylococcus aureus* infection in a human. The uses can include the treatment comprising administration to said human of a composition, the composition comprising at least two bacteriophages comprising a nucleic acid or a genome that includes a nucleotide sequence selected from the group consisting of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10 and a sequence having at least 93% identity to any of SEQ ID NOS: 1-10, wherein the infection is not a pulmonary *S. aureus* infection. In some uses, the one more of the bacteriophage are not naturally occurring.

BRIEF DESCRIPTION OF THE DRAWINGS

Embodiments will now be described, by way of example only, with reference to the accompanying drawings, in which:

FIG. 4 is a summary chart showing phage candidates' single-copy nucleic acid similarities are shown in (% nucleotide identity). Within each cell, values are percent identity across the total alignment. The percent of the alignment made up by gaps is reported separately in parentheses by these gaps are included in the total percent identity.

DETAILED DESCRIPTION

Figure 1:
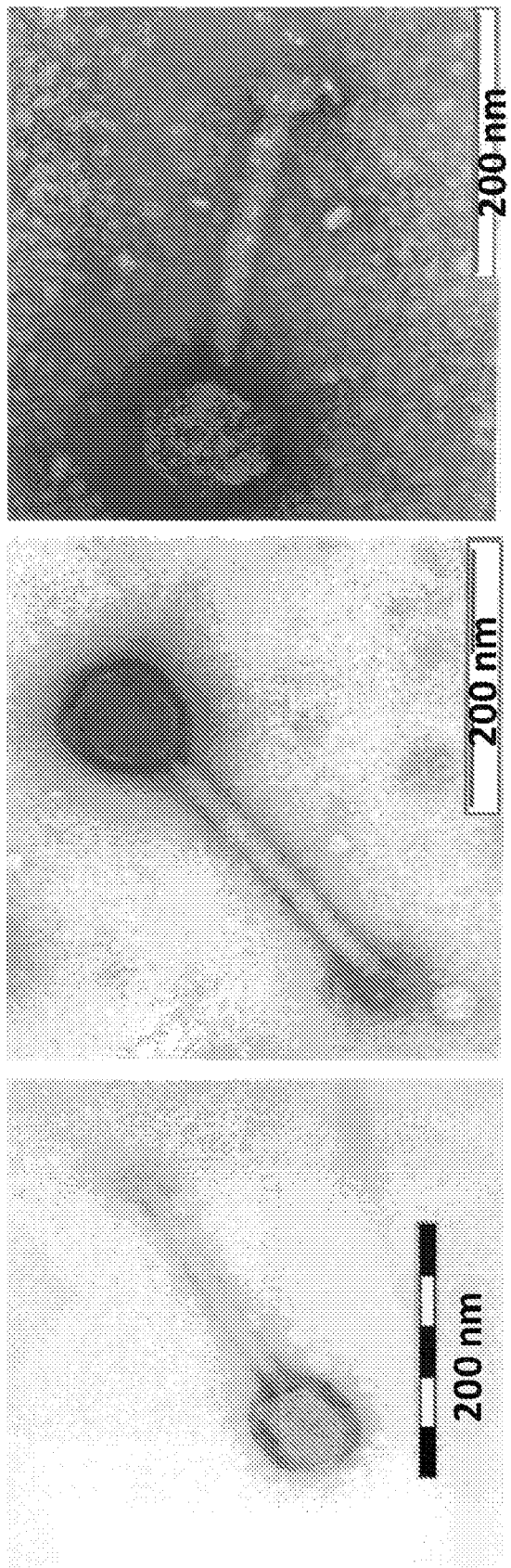
FIGS. 1A, 1B, and 1C shows transmission electron microscopy (TEM) images of examples of three component bacteriophage Sa83 (FIG. 1A), Sa87 (FIG. 1B), and J-Sa36 (FIG. 1C). The images show the straight contractile tail and narrow neck that are characteristic of phages belonging to the order Caudovirales, family Myoviridae.

It is to be understood that the present disclosure is not limited to particular embodiments described, as such may, of course, vary. It is also to be understood that the terminology used herein is for the purpose of describing particular embodiments only, and is not intended to be limiting, since the scope of the present disclosure will be limited only by the appended claims.

The detailed description of the present disclosure is divided into various sections only for the reader's convenience and disclosure found in any section may be combined with that in another section. Unless defined otherwise, all technical and scientific terms used herein have the same meaning as commonly understood by one of ordinary skill in the art to which the present disclosure belongs.

Definitions

It must be noted that as used herein and in the appended claims, the singular forms "a," "an," and "the" include plural referents unless the context clearly dictates otherwise. Thus, for example, reference to "a bacteriophage composition" includes a plurality of such candidate agents and reference to "the bacteriophage" includes reference to one or more bacteriophages and equivalents thereof known to those skilled in the art, and so forth.

As used herein, the term "about" when used before a numerical designation, e.g., temperature, time, amount, concentration, and such other, including a range, indicates approximations which may vary by (+) or (−) 10%, 5%, or 1%.

When a range (e.g., dosage range) is listed herein, it is to be understood that the value may include any individual value or range within the recited range(s), including endpoints.

The term "mutant" as used herein refers to a bacteriophage differing genetically from Sa87, J-Sa36, or Sa83 but still retaining the ability to infect and lyse *Staphylococcus aureus* target bacteria. Mutants typically comprise e.g., silent mutations, conservative mutations, minor deletions, and/or minor replications of genetic material, and retain phenotypic characteristics of the reference bacteriophage. In an embodiment, the mutants retain any observable characteristic or property that is dependent upon the genome of the bacteriophage as described herein, i.e. phenotypic characteristics of said bacteriophage and/or lytic activity against *Staphylococcus* species. Preferred mutants retain the ability to infect and lyse *Staphylococcus aureus* target bacteria and have less than 10% nucleic acid variation as compared to the genome of the reference bacteriophage, even more preferably less than 7%, more preferably less than 1%. Alternatively, or in combination, mutants have preferably less than 7% amino acid variation in a coded polypeptide sequence as compared to a polypeptide of the reference bacteriophage. Examples of phage that have less than 10% nucleic acid variation across the entire genome when compared to any one of Sa87, J-Sa36, or Sa83 and had lytic activity against *Staphylococcus aureus* target bacteria include Sa38, Sa41, Sa42, Sa44, Sa51, Sa76, and Sa81 (FIG. 4).

The term "% identity" or "% sequence identity" in relation to nucleic acid or amino acid sequences designates the level of identity or homology between said sequences and may be determined by techniques known in the art. Any of a variety of sequence alignment methods can be used to determine percent identity, including, without limitation, global methods, local methods and hybrid methods, such as segment approach methods. Protocols to determine percent identity are routine procedures within the scope of one skilled in the art. Global methods align sequences from the beginning to the end of the molecule and determine the best alignment by adding up scores of individual nucleotide pairs and by imposing gap penalties. Non-limiting methods include, e.g., CLUSTAL W, see, e.g., Julie D. Thompson et al., CLUSTAL W: Improving the Sensitivity of Progressive Multiple Sequence Alignment Through Sequence Weighting, Position-Specific Gap Penalties and Weight Matrix Choice, 22(22) Nucleic Acids Research 4673-4680 (1994); and iterative refinement. Non-limiting methods include, e.g., BLAST, Match-box, see, e.g., Align-M, see, e.g., Ivo Van Walle et al., Align-M—A New Algorithm for Multiple Alignment of Highly Divergent Sequences, Bioinformatics 20(9):1428-1435 (2004). This definition also refers to, or may be applied to, the compliment of a test sequence. The definition also includes sequences that have deletions and/or additions, as well as those that have substitutions. As described below, the preferred algorithms can account for gaps and the like. Preferably, identity exists over a region that is at least about 100 nucleotides in length, or more preferably over a region that is 100-1000 or more nucleotides in length.

The term "complementation" as used herein refers to the ability of a bacteriophage with a particular genome to compensate for a different, distinct bacteriophage with a different genome. More specifically, bacteriophage insensitive mutants colonies (of target bacteria) may arise to a particular bacteriophage but may still be sensitive to a different bacteriophage. In other words, bacteriophage resistant mutant bacteria arising to one phage are still sensitive to another phage.

The term "generalized transduction" as used herein refers process by which any bacterial DNA may be transferred to another bacterium via a bacteriophage. It is a rare event; a very small percentage of phage particles happen to carry a donor bacterium's DNA, on the order of 1 phage in 10,000. In essence, this is the packaging of bacterial DNA into a viral envelope.

The term "treat" or "treating" as used herein is intended to encompass prophylactic treatment as well as corrective treatment (treatment of a subject already suffering from a disease).

The term "lytic" or "lytic activity" designates the property of a bacteriophage to cause lysis of a bacterial cell. The lytic activity of a bacteriophage can be tested on a bacteria (e.g., *S. aureus* strains) according to techniques known in the art. The lytic cycle is named for the process that occurs when a phage has infected a cell, replicated new phage particles, and bursts through the host cell membrane. Some phage exhibit a lysogenic cycle during which the bacteriophage DNA remains practically dormant due to active repression of bacteriophage processes. Whenever the bacteria divides, the DNA of the phage is copied as well. In this way, the virus can continue replicating within its host without lysing the host. At a certain point, conditions may change and the phage enters a lytic cycle. "Obligately lytic" refers to phage that are unable to undergo a lysogenic cycle.

A use or method typically comprises administering a bacteriophage or bacteriophage composition described herein to a subject. As used herein, a "subject" is a mammal, such as a human or other animal. Preferably, the subject is a human.

The term "isolated" as used herein indicates that the bacteriophage are removed from its original environment in which it naturally occurs. In particular, an isolated bacteriophage is, e.g., cultivated, cultured separately from the environment in which it is naturally located.

The term "purified" as used herein indicates that the bacteriophage are removed from manufacturing host bacteria. In particular, a purified bacteriophage has production impurities, such as bacterial components, removed from its manufacturing or production environment. Bacterial components include but are not limited to bacterial host proteins, lipids, and/or bacterial endotoxin. The term "purified" may also refer to genetic purification in which the strain of bacteriophage is genetically homogenous.

As used herein, the term "substantially purified" refers to a composition containing less than 1%, less than 0.1%, less than 0.001%, or no detectable amount of contaminants such as host bacterial proteins or endotoxin. Also, as used herein, the term "substantially pure" when used to describe a bacteriophage strain refers to the genetic purity of the composition such that the strain is greater than 99%, greater than 99.9%, greater than 99.999%, or 100% of one particular genome sequence.

Typically, a composition is substantially pure when at least 80%, at least 85%, at least 90%, at least 95%, at least 98%, or at least 99% of the total material (by volume, by wet or dry weight, or by mole percent or mole fraction) in a sample is free of impurities or genetic variants.

The term "subject" or "patient" refers to a human or non-human animal. Preferably, the subject or patient is in need of treatment with the composition as described herein, e.g., has a bacterial infection susceptible to treatment with the composition.

A "synergistic amount" as used herein refers to the sum of a first amount (e.g., a bacteriophage) and a second amount (e.g., a different bacteriophage) that results in a synergistic effect (i.e. an effect greater than an additive effect). Therefore, the terms "synergy", "synergism", "synergistic", "combined synergistic amount", and "synergistic therapeutic effect" which are used herein interchangeably, refer to a measured effect of the compound administered in combination where the measured effect is greater than the sum of the individual effects of each of the compounds provided herein administered alone as a single agent.

The term "substantially free" as used herein can refer to something having less than 10% of the substance that it is to be free from. For example, 0.01% to 10% free, including any subvalue and subrange therein. For example, 0.01, 0.02, 0.03, 0.04, 0.05, 0.06, 0.07, 0.08, 0.09, 1, 2, 3, 4, 5, 6, 7, 8, 9, or 10%.

Additional terms and phrases are defined below.

Bacteriophage Compositions

Provided herein are bacteriophage compositions, including compositions that are substantially free of bacterial components such as for example bacterial endotoxins, bacterial host protein, and the like. The compositions can include one or more obligately lytic bacteriophages and optionally a cryoprotectant. The bacteriophage can be any phage as described herein, include at least one phage with a nucleic acid sequence or a genome including a nucleotide sequence having at least 93% identity to any one of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, or SEQ ID NO: 10. In some aspects at least one of the bacteriophage do not have 100% identity to one or more of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, or SEQ ID NO: 10. In some aspects one or more of the bacteriophage are non-naturally occurring. In some aspects an individual bacteriophage is not prone to generalized transduction and/or does not carry antibiotic resistance genes.

In embodiments, the bacteriophage differ in nucleotide or genomic sequence by up to about 10%, up to about 9%, up to about 8%, up to about 7%, up to about 6%, up to about 5%, up to about 4%, up to about 3%, up to about 2% or up to about 1% compared to the genomic sequence of Sa87 (SEQ ID NO.: 1), J-Sa36 (SEQ ID NO.: 2), and/or Sa83 (SEQ ID NO.: 3). Examples of phage that have less than 10% nucleic acid variation across the entire genome when compared to any one of Sa87, J-Sa36, or Sa83 and had lytic activity against *Staphylococcus aureus* target bacteria include Sa38 (SEQ ID NO.: 4), Sa41 (SEQ ID NO.: 5), Sa42 (SEQ ID NO.: 6), Sa44 (SEQ ID NO.: 7), Sa51 (SEQ ID NO.: 8), Sa76 (SEQ ID NO.: 9), and Sa81 (SEQ ID NO.: 10) (FIG. 4). In some aspects one or more of the bacteriophage, compositions of bacteriophage, and methods of uses include one or more bacteriophage that have a nucleic acid having a sequence that is 90%-99.99% identity 90%, 91%, 92%, 93%, 94%, 95%, 96%, 97%, 98%, 99%, 99.9% or 100% identity to one or more of SEQ ID NOs. 1-10, or to a nucleic acid sequence of Sa87, J-Sa36, Sa83, Sa38, Sa41, Sa42, Sa44, Sa51, Sa76, and Sa81. In some aspects one or more of the bacteriophage are non-naturally occurring while in others one or more phage are naturally occurring. In one embodiment, the bacteriophage composition includes one or more additional bacteriophage. The bacteriophages disclosed herein and mutants thereof are useful for treating a bacterial infections, in particular a *Staphylococcus aureus* infection.

The bacteriophages Sa87 (deposited under ECACC reference no. 17020901), J-Sa36 (deposited under ECACC reference no. 17020903), and Sa83 (deposited under ECACC reference no. 17020902) were deposited at the European Collection of Cell Cultures (ECACC), Culture Collections, Public Health England, Porton Down, Salisbury, Wiltshire, SP4 0JG, United Kingdom, on 9 Feb. 2017. All of the deposits were made under the provisions of the Budapest Treaty on the International Recognition of the Deposit of Microorganisms for the Purposes of Patent Procedure.

In an aspect, provided herein are bacteriophage compositions substantially free of bacterial components including bacterial endotoxins and bacterial host protein. In some embodiments the compositions can include one or more obligately lytic bacteriophages capable of complementation. The bacteriophage can have a nucleic acid sequence or a genome, that include a nucleotide sequence having at least 93% but not 100% identity to any one of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, and a cryoprotectant, The composition's target bacteria range can be broader than the range of any individual bacteriophage or the phage collectively in the composition, or have an effectiveness that is greater than the sum of effectiveness of the individual bacteriophage. The compositions can have at least one bacteriophage that is not naturally occurring. The compositions can include at least one naturally occurring phage or can exclude naturally occurring phage.

In an aspect, provided herein are bacteriophage compositions substantially free of bacterial components such as bacterial endotoxin, bacterial host protein, and the like. The bacteriophage compositions may include at least one obligately lytic bacteriophage and optionally a storage media for storage at a temperature selected at or below 8° C. The bacteriophage can include a nucleic acid or a genome, that includes a nucleotide sequence having at least 93% but not 100% identity to any one of SEQ ID NO: 1, SEQ ID NO: 2, SEQ ID NO: 3 SEQ ID NO: 4, SEQ ID NO: 5, SEQ ID NO: 6, SEQ ID NO: 7, SEQ ID NO: 8, SEQ ID NO: 9, SEQ ID NO: 10. One or more individual bacteriophage may not be prone to generalized transduction and does not carry antibiotic resistance genes. The compositions can have at least one bacteriophage that is not naturally occurring. The compositions can include at least one naturally occurring phage or can exclude naturally occurring phage.

In embodiments, a bacteriophage composition includes at least one bacteriophage having nucleic acid or genomic nucleic acid sequences having at least 93%, but not 100%, identity to any one of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10. In embodiments, a bacteriophage composition includes at least two bacteriophages having nucleic acid or genomic nucleic acid sequences having at least 93%, but not 100%, identity to any one of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10. In embodiments, a bacteriophage composition includes at least three bacteriophages having nucleic acid or genomic nucleic acid sequences having at least 93%, but not 100%, identity to any one of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10. In another embodiment a bacteriophage composition includes bacteriophage having at least 93%, but not 100%, identity to any one of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10. In embodiments, a bacteriophage composition consists essentially of bacteriophage having nucleic acid or genomic nucleic acid sequences having at least 93%, but not 100%, identity to any one of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10. A bacteriophage composition including two or more bacteriophages may be referred to herein as a "panel" of bacteriophages. In some embodiments where the composition includes one or more bacteriophage that do not have 100% identity to one or more of SEQ ID NOs: 1-10, the compositions can include at least one bacteriophage that does have 100% identity. The compositions can have at least one bacteriophage that is not naturally occurring. The compositions can include at least one naturally occurring phage or can exclude naturally occurring phage.

In embodiments, a bacteriophage composition includes one or more bacteriophages having nucleic acid or genomic nucleic acid sequences having at least 93%, but not 100%, identity to any one of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10. In embodiments, a bacteriophage composition includes two or more bacteriophages having genomic nucleic acid sequences having at least 93% but not 100% identity to any one of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10. In embodiments, a bacteriophage composition includes three or more bacteriophage having at least 93% but not 100% identity to any one of SEQ ID NO: 1, SEQ ID NO: 2, SEQ ID NO: 3 SEQ ID NO: 4, SEQ ID NO: 5, SEQ ID NO: 6, SEQ ID NO: 7, SEQ ID NO: 8, SEQ ID NO: 9, SEQ ID NO: 10. The compositions can have at least one bacteriophage that is not naturally occurring. The compositions can include at least one naturally occurring phage or can exclude naturally occurring phage.

In embodiments, the bacteriophage composition can be an alternative to conventional antibacterial agents/therapeutics, and overcomes one or more problems associated therewith. In some aspects, the bacteriophage composition can be utilized as co-treatment or in combination with conventional antibacterial agents/therapeutics. In some aspects the methods herein can include the use of the bacteriophage and compositions described herein to treat a patient that has already been treated for his/her infection with another therapy such as an antibiotic treatment. The patient can be identified and/or selected for the method based upon having received such prior treatment, including a prior treatment where the infection was not completely eliminated or where the infection persists. In other aspects the patient can be selected due to being one that has not received another prior treatment.

In embodiments, the bacteriophage composition can include one or more additional bacteriophages. In a preferred embodiment, the one or more additional bacteriophages are suitable for treating a bacterial infection, in particular a *Staphylococcus* infection. The additional one or more phage can be natural or non-naturally occurring. The one or more additional phage can be a phage with 90%-100% nucleic acid sequence identity to any of the phage described herein, including phage associated with SEQ ID NOs: 1-10.

The term "consists essentially of" as used herein means that only the bacteriophage(s) explicitly indicated are present in the bacteriophage composition, but that said composition may also contain a further non-bacteriophage constituent, such as an appropriate carrier, diluent, antibiotic (e.g., chemical antibiotic), etc.

In an aspect, the bacteriophage composition includes at least one, at least two, or at least three bacteriophages such that the composition is effective against at least about 60% of target bacterial strains. For example, the bacteriophage composition is effective against (e.g., kills or lyses) at least 60% of *Staphylococcus aureus* strains in a given panel. In one embodiment, the bacteriophage composition includes at least one, at least two, or at least three bacteriophages such that the composition is effective against at least about 70% of target bacterial strains. In one embodiment, the bacteriophage composition includes at least one, at least two, or at least three bacteriophages such that the composition is effective against at least about 75% of target bacterial strains. In one embodiment, the bacteriophage composition includes at least one, at least two, or at least three bacteriophage such that the composition is effective against at least about 76% of target bacterial strains. In one embodiment, the bacteriophage composition includes at least one, at least two, or at least three bacteriophages such that the composition is effective against at least about 77% of target bacterial strains. In one embodiment, the bacteriophage composition comprises at least one, at least two, or at least three bacteriophages such that the composition is effective against at least about 78% of target bacterial strains. In one embodiment, the bacteriophage composition includes at least one, at least two, or at least three bacteriophages such that the composition is effective against at least about 79% of target bacterial strains. In one embodiment, the bacteriophage composition includes at least one, at least two, or at least three bacteriophages such that the composition is effective against at least about 80% of target bacterial strains. In one embodiment, the bacteriophage composition includes at least one, at least two, or at least three bacteriophages such that the composition is effective against at least about 81% of target bacterial strains. In one embodiment, the bacteriophage composition includes at least one, at least two, or at least three bacteriophages such that the composition is effective against at least about 82% of target bacterial strains. In one embodiment, the bacteriophage composition includes at least one, at least two, or at least three r bacteriophage such that the composition is effective against at least about 83% of target bacterial strains. In one embodiment, the bacteriophage composition includes at least one, at least two, or at least three bacteriophages such that the composition is effective against at least about 84% of target bacterial strains. In one embodiment, the bacteriophage composition includes at least one, at least two, or at least three bacteriophage such that the composition is effective against at least about 85% of target bacterial strains. In one embodiment, the bacteriophage composition includes at least one, at least two, or at least three bacteriophage such that the composition is effective against at least about 90% of target bacterial strains. In another embodiment, the bacteriophage composition includes at least one, at least two, or at least three bacteriophages such that the composition is effective against one or more bacterial strains (or isolates) from a subject with a bacterial infection.

In embodiments, the range of target bacteria of the composition is broader than the range of target bacteria of any single bacteriophage included within the composition. Such activity can be considered synergistic as the effect of the composition (target killing range) is greater than the sum of individual effects (target killing range) of each component bacteriophage.

In one embodiment (alternatively or additionally) a "mutant" bacteriophage is capable of lysing some or all the same target bacterial strains as one or more of Sa87, J-Sa36, Sa83, Sa38, Sa41, Sa42, Sa44, Sa51, Sa76, and/or Sa81, and/or further capable of lysing one or more additional bacterial strains. In one embodiment, a mutant may have at least 90%, 91%, 92%, 93%, 94%, 95%, 96%, 97%, 98%, or 99% sequence identity to a nucleic acid sequence of one or more of Sa87, J-Sa36, Sa83, Sa38, Sa41, Sa42, Sa44, Sa51, Sa76, and Sa81. In some embodiments, a mutant or variant may have at least 90%, 91%, 92%, 93%, 94%, 95%, 96%, 97%, 98%, or 99% sequence identity across its entire genome when compared to one more of Sa87, J-Sa36, Sa83, Sa38, Sa41, Sa42, Sa44, Sa51, Sa76, and Sa81. In one embodiment, a mutant may have at least 93%, 94%, 95%, 96%, 97%, 98%, or 99% sequence identity across its entire genome when compared to SEQ ID NO.: 1, SEQ ID NO.: 2, SEQ ID NO.: 3, SEQ ID NO: 4, SEQ ID NO: 5, SEQ ID NO: 6, SEQ ID NO: 7, SEQ ID NO: 8, SEQ ID NO: 9, or SEQ ID NO: 10.

In embodiments, a "mutant" may be a bacteriophage progeny. A bacteriophage progeny may be a bacteriophage obtainable after lysing *Staphylococcus* (e.g., *S. aureus*) target bacteria using a bacteriophage as described herein (i.e., the "parent bacteriophage"). In other words, the bacteriophage progeny may be a second (or further) generation bacteriophage.

In embodiments, a bacteriophage progeny is obtainable by contacting one or more bacteriophage(s) described herein, including for example, one selected from Sa87, J-Sa36, and/or Sa83 with a *Staphylococcus* target bacteria such that the one or more bacteriophage(s) infects and lyses the target bacteria; and obtaining a bacteriophage released following lysis of the target bacteria. The bacteriophage progeny will typically comprise one or more nucleotide(s) mutation(s) when compared to the relevant parent bacteriophage.

The term "obtainable" as used herein also encompasses the term "obtained." In one embodiment, the term "obtainable" means obtained.

The bacteriophage composition targets (and preferably kills) one or more *Staphylococcus* species or strain. In embodiments, the composition targets *Staphylococcus aureus*, including e.g. one or more strains of *Staphylococcus aureus*. In one embodiment, a *Staphylococcus* species or strain targeted by the bacteriophage is a *Staphylococcus* species or strain resistant to chemical antibiotics, such as a multi-drug resistant *Staphylococcus* species or strain. In one embodiment, a *Staphylococcus* species or strain targeted by the bacteriophage is a *Staphylococcus aureus* strain resistant to chemical antibiotics, such as a multi-drug resistant *Staphylococcus aureus*.

In embodiments, the bacteriophage compositions described herein have been shown to be particularly effective at treating *Staphylococcus* species or strain infections resistant to chemical antibiotics, such as a multi-drug resistant *Staphylococcus* species or strain. In embodiments, the bacteriophage compositions described herein have been shown to be particularly effective at treating *Staphylococcus aureus* infections resistant to chemical antibiotics, such as a multi-drug resistant *Staphylococcus aureus* strain.

The bacteriophages may be provided in the form of a single therapeutic composition (preferred) or as a number of separate compositions each comprising one or more members of the composition. In embodiments where the bacteriophages are provided in a number of separate compositions, said bacteriophages may be administered to a subject sequentially or simultaneously (suitably simultaneously).

In embodiments where more than one bacteriophage is present in the bacteriophage composition, the composition is formulated such that each bacteriophage may be present at a ratio of between 1:10 and 10:1 (or any sub value or subrange there between including the endpoints) compared to the amount (e.g., concentration) of any other bacteriophage in the composition. In embodiments, each bacteriophage is present at a ratio of about 1:1 compared to one or more other bacteriophages in the composition. In embodiments, each bacteriophage is present at a ratio of about 1:2 compared to one or more other bacteriophages in the composition. In embodiments, each bacteriophage is present at a ratio of about 1:3 compared to one or more other bacteriophages in the composition. In embodiments, each bacteriophage is present at a ratio of about 1:4 compared to one or more other bacteriophages in the composition. In embodiments, each bacteriophage is present at a ratio of about 1:5 compared to one or more other bacteriophages in the composition. In embodiments, each bacteriophage is present at a ratio of about 1:6 compared to one or more other bacteriophages in the composition. In embodiments, each bacteriophage is present at a ratio of about 1:7 compared to one or more other bacteriophages in the composition. In embodiments, each bacteriophage is present at a ratio of about 1:8 compared to one or more other bacteriophages in the composition. In embodiments, each bacteriophage is present at a ratio of about 1:9 compared to one or more other bacteriophages in the composition. In embodiments, each bacteriophage is present at a ratio of about 1:10 compared to one or more other bacteriophages in the composition. In embodiments, each bacteriophage is present at a ratio of about 10:1 compared to one or more other bacteriophages in the composition. In embodiments, each bacteriophage is present at a ratio of about 5:1 compared to one or more other bacteriophages in the composition. In embodiments, each bacteriophage is present at a ratio of about 10:3 compared to one or more other bacteriophages in the composition. In embodiments, each bacteriophage is present at a ratio of about 5:2 compared to one or more other bacteriophages in the composition. In embodiments, each bacteriophage is present at a ratio of about 2:1 compared to one or more other bacteriophages in the composition. In embodiments, each bacteriophage is present at a ratio of about 5:3 compared to one or more other bacteriophages in the composition. In embodiments, each bacteriophage is present at a ratio of about 10:7 compared to one or more other bacteriophages in the composition. In embodiments, each bacteriophage is present at a ratio of about 5:4 compared to one or more other bacteriophages in the composition.

A bacteriophage for inclusion in a composition may be propagated by any suitable method known in the art. For example, one or more bacteriophage(s) may be grown separately in host bacterial strains capable of supporting growth of the bacteriophage. Typically, the bacteriophage will be grown in said host bacterial strain to high concentrations, titrated and combined to form the composition. The amount of each bacteriophage employed (e.g., in a bacteriophage composition, method or use) will depend upon its virulence against the target bacterial species.

The amount of each bacteriophage employed (e.g. in a bacteriophage composition, method or use as described herein) may depend upon its virulence against the target bacterial isolate.

Count bacterial strains may be used in the development of a composition, i.e., bacterial strains which are indicators for individual prospective members of the composition (e.g. panel). A count strain may permit at least 1000 times more plaque formation by one prospective member of the bacteriophage composition than another. In this way, a composition (e.g. panel) that is consistently effective against a wide range of bacterial isolates may be achieved.

Typically, the one or more bacteriophage(s) may be combined to form a composition including at least about $1\times10^5$, $1\times10^6$, $1\times10^7$, $1\times10^8$, $1\times10^9$ or $1\times10^{10}$ or $1\times10^{11}$ plaque forming units (PFU) of each phage per ml of composition. The composition may include $1\times10^5$ to $1\times10^{11}$ PFU of each phage per ml of composition. In embodiments, the composition may include $1\times10^5$ to $1\times10^6$ PFU, $1\times10^5$ to $1\times10^7$ PFU, $1\times10^5$ to $1\times10^8$ PFU, $1\times10^5$ to $1\times10^9$ PFU, or $1\times10^5$ to $1\times10^{10}$ PFU of each phage per ml of composition. In embodiments, the composition may include $1\times10^6$ to $1\times10^7$ PFU, $1\times10^6$ to $1\times10^8$ PFU, $1\times10^6$ to $1\times10^9$ PFU, $1\times10^6$ to $1\times10^{10}$ PFU, or $1\times10^6$ to $1\times10^{11}$ PFU of each phage per ml of composition. In embodiments, the composition may include $1\times10^7$ to $1\times10^8$ PFU, $1\times10^7$ to $1\times10^9$ PFU, $1\times10^7$ to $1\times10^{10}$ PFU, or $1\times10^7$ to $1\times10^{11}$ PFU of each phage per ml of composition. In embodiments, the composition may include $1\times10^8$ to $1\times10^9$ PFU, $1\times10^8$ to $1\times10^{10}$ PFU, or $1\times10^8$ to $1\times10^{11}$ PFU of each phage per ml of composition. In embodiments, the composition may include $1\times10^9$ to $1\times10^{10}$ PFU or $1\times10^9$ to $1\times10^{11}$ PFU of each phage per ml of composition. In embodiments, the composition may include $1\times10^{10}$ to $1\times10^{11}$ PFU of each phage per ml of composition. In embodiments, one or more bacteriophage(s) may be combined to form a composition include $1\times10^5$, $1\times10^6$, $1\times10^7$, $1\times10^8$, $1\times10^9$ or $1\times10^{10}$, or $1\times10^{11}$ PFU of each phage per ml of composition. In some embodiments, the composition includes equal (or substantially equal) concentrations of each bacteriophage included herein. Suitable concentrations include any value or subrange within the indicated ranges, including endpoints.

In some aspects, the bacteriophage(s) in the composition are purified or substantially purified.

When selecting bacteriophages for inclusion in the composition, the methods include (a) providing two or more different bacteriophages, wherein each of said two or more different bacteriophages independently retards growth of a *Staphylococcus* species or strain under defined growth conditions; (b) combining at least two of said two or more different bacteriophages; and (c) determining growth of the *Staphylococcus* species or strain in the presence of said combination of two or more different bacteriophages, wherein the *Staphylococcus* species or strain growth conditions are the same or equivalent in steps (a) and (c); wherein, if said combination retards growth of the *Staphylococcus* species or strain at least equal to the greatest growth retardation achieved independently by any one of said two or more different bacteriophages, the combination is accepted as a composition of bacteriophages. In embodiments, if said combination retards growth of the target bacterial species or strain less than the greatest growth retardation achieved independently by any one of said two or more different bacteriophages, the combination is initially rejected as a composition of bacteriophages.

Provided herein is a bacteriophage composition including one or more of bacteriophages Sa87, J-Sa36 and Sa83 (and optionally mutants and identity variants thereof). The bacteriophage composition comprises or consists essentially of Sa87, J-Sa36 and Sa83. The bacteriophage composition comprises or consists essentially of bacteriophage(s) having a nucleotide genome sequence 90%-100% identical to a phage or phage sequence described herein. For example, in one aspect a bacteriophage composition can include or consist essentially of a phage having at least 93% but not 100% identical to the genome sequence of Sa87, J-Sa36 and Sa83 (or any other sequence described herein). In embodiments, only bacteriophage having a nucleotide genome sequence at least 93% identity to the genome sequence of Sa87, J-Sa36 and/or Sa83 are present in the composition. In some embodiments, the bacteriophage in the composition consist of bacteriophage having a nucleotide genome sequence at least 93% identity to the genome sequence of at least one of Sa87, J-Sa36 and/or Sa83, and no other (detectable) bacteriophage are present in the composition. In embodiments, the only bacteriophage present in the composition that target *S. aureus* are bacteriophage having a nucleotide genome sequence at least 93% identity to the genome sequence of Sa87, J-Sa36 and/or Sa83. In embodiments, the bacteriophage having a nucleotide genome sequence at least 93% identity to the genome sequence of Sa87, J-Sa36 and/or Sa83 do not have 100% identity to the genome sequence of Sa87, J-Sa36 and/or Sa83. In some embodiments, the composition includes at least one bacteriophage as described herein, or at least two, at least three or more. In some embodiments the compositions include one or more bacteriophage of Sa87, J-Sa36 and Sa83, and one or more other bacteriophage having at least 90-99% sequence identity to at least one of the same, or at least one other bacteriophage effective against S. *Aureus*.

In some embodiments, a bacteriophage composition may further comprise one or more additional bacteriophages. Said one or more additional bacteriophages may target a *Staphylococcus aureus* species or strain, or a different bacterial target, for example selected from one or more of the following genera *Staphylococcus, Helicobacter, Klebsiella, Listeria, Mycobacterium, Escherichia, Meningococcus, Campylobacter, Streptococcus, Enterococcus, Shigella, Pseudomonas* (e.g., *Pseudomonas aeruginosa*), *Burkholderia, Clostridium, Legionella, Acinetobacter, Salmonella,* or combinations thereof.

The one or more additional bacteriophages may be one taught in WO 2009/044163 (incorporated herein by reference in its entirety for all of its bacteriophage, compositions, composition components/excipients, and methods of use), a bacteriophage K and/or bacteriophage P68 described therein.

In some embodiments, the bacteriophage composition comprises one or more bacteriophage and a preservative agent for storage. Storage includes frozen, refrigeration, and room temperature storage. In one embodiment, the preservative agent is glycerol. In an embodiment, the preservative agent is present in the composition in an amount sufficient to preserve the composition, for example during storage in a freezer or ultra-freezer (e.g., at temperatures from about 0° C. to about −80° C., more preferably from about −20° C. to about −80° C., most preferably about −80° C.), or in liquid nitrogen. In another embodiment, the preservative agent is present in the composition in an amount sufficient to preserve the composition during long-term storage, e.g., in a freezer, ultra freezer, or liquid nitrogen. In one embodiment, the preservative agent is between about 5% and about 50% glycerol; more preferably between about 10% and about 30% glycerol; most preferably about 20% glycerol. Suitable concentrations may be any value or subvalue within the recited ranges, including endpoints.

Formulations

Provided herein are bacteriophage compositions that include or consist essentially of one more of the bacteriophage described herein. In some aspects the compositions can be substantially free of bacterial components, such as for example, bacterial endotoxin, bacterial host cell components and materials (e.g., protein), and the like. In some embodiments, the compositions can one or more obligately lytic bacteriophages. The one or more bacteriophage may include a nucleic acid, for example, a genome including a nucleotide sequence having 90%-100% identity to one or more of SEQ ID NOs: 1-10. In some embodiments, at least one or more phage have at least 93%, but not 100%, nucleic acid sequence identity to any one of SEQ ID NOs: 1-10, preferably to SEQ ID NO: 1, SEQ ID NO: 2, or SEQ ID NO: 3. Each individual bacteriophage may be one that is not prone to generalized transduction and/or does not carry antibiotic resistance genes. The phage can be naturally occurring or non-naturally occurring. In some embodiments for example, in compositions with more than one bacteriophage, at least one can be naturally occurring, at least one can be non-naturally occurring, or none can be naturally occurring. The compositions optionally may include a cryoprotectant or excipient. The excipient may stabilize phage potency or reduce potency loss over time, for example.

In some embodiments, bacteriophage compositions provided herein further include a pharmaceutically acceptable carrier, diluent, excipient or combinations thereof. Suitable carriers, diluents and/or excipients may include isotonic saline solutions, such as phosphate-buffered saline. "Pharmaceutically acceptable excipient" and "pharmaceutically acceptable carrier" refer to a substance that aids the administration of an active agent to and/or absorption by a subject and can be included in the compositions of the present disclosure without causing a significant adverse toxicological effect on the patient. Non-limiting examples of pharmaceutically acceptable excipients include water, NaCl, normal saline solutions, lactated Ringer's, normal sucrose, normal glucose, binders, fillers, disintegrants, lubricants, coatings, sweeteners, flavors, salt solutions (such as Ringer's solution), alcohols, oils, gelatins, carbohydrates such as lactose, amylose or starch, fatty acid esters, hydroxymethycellulose, polyvinyl pyrrolidine, and colors, and the like. Such preparations can be sterilized and, if desired, mixed with auxiliary agents such as lubricants, preservatives, stabilizers, wetting agents, emulsifiers, salts e.g. for influencing osmotic pressure, buffers, coloring, and/or aromatic substances and the like that do not deleteriously react with the compounds of the disclosure. One of skill in the art will recognize that other pharmaceutical excipients are useful in the present disclosure.

A bacteriophage composition as described herein may be formulated as a disinfectant composition. The disinfectant composition may be in the form of a spray or liquid wash for a surface. The composition may be a hand wash. Suitably where the composition is a formulation for topical application, it may take the form of a lotion, cream, ointment, paste, gel, foam, or any other physical form as a carrier generally known for topical administration. Such thickened topical formulations are particularly advantageous because the formulations adhere to the area of the skin on which the material is placed, thus allowing a localized high concentration of bacteriophages to be introduced to the particular area to be disinfected. For example, paraffin- and lanolin-based creams, which are particularly useful for the application of product to the nasal cavity, are generally known in the art. However, other thickeners, such as polymer thickeners, may be used. The formulations may also comprise one or more of the following: water, preservatives, active surfactants, emulsifiers, anti-oxidants, or solvents.

A bacteriophage composition as described herein may be formulated for nasal, oral, parenteral, intramuscular, intra-articular, intravenous, subcutaneous, transdermal, ocular or aural administration. Such a bacteriophage preparation may be used directly, refrigerated, lyophilized, stored frozen in aqueous or other solution, optionally with an appropriate cryoprotectant (e.g. 20% glycerol), freeze dried and rehydrated prior to use, or rendered stable in some other formulation including (but not limited to) tablet, emulsion, ointment, or impregnated wound dressing or other item. In embodiments, the cryoprotectant is 10-30% glycerol. In embodiments, the cryoprotectant is 10%, 11%, 12%, 13%, 14%, 15%, 16%, 17%, 18%, 19% 20%, 21%, 22%, 23%, 24%, 25%, 26%, 27%, 28%, 29%, or 30% glycerol. In embodiments, the bacteriophage composition includes saline (e.g., phosphate buffered saline, with or without magnesium). In embodiments, the bacteriophage composition includes a buffer. In embodiments, the buffer includes calcium or magnesium salts. In an embodiment, the buffer includes phosphate buffered saline and $MgSO_4$. The buffer may include 1 mM to 20 mM $MgSO_4$, 2 mM to 19 mM $MgSO_4$, 3 mM to 17 mM $MgSO_4$, 4 mM to 16 mM $MgSO_4$, 5 mM to 15 mM $MgSO_4$, 6 mM to 14 mM $MgSO_4$, 7 mM to 13 mM $MgSO_4$, 8 mM to 12 mM $MgSO_4$, 9 mM to 11 mM $MgSO_4$, or about 10 mM $MgSO_4$. The concentration may be any value or subrange within the recited ranges, including endpoints. For example, the buffer may include about 1 mM $MgSO_4$, about 2 mM $MgSO_4$, about 3 mM $MgSO_4$, about 4 mM $MgSO_4$, about 5 mM $MgSO_4$, about 6 mM $MgSO_4$, about 7 mM $MgSO_4$, about 8 mM $MgSO_4$, about 9 mM $MgSO_4$, about 10 mM $MgSO_4$, about 11 mM $MgSO_4$, about 12 mM $MgSO_4$, about 13 mM $MgSO_4$, about 14 mM $MgSO_4$, about 15 mM $MgSO_4$, about 16 mM $MgSO_4$, about 17 mM $MgSO_4$, about 18 mM $MgSO_4$, about 19 mM $MgSO_4$, or about 20 mM $MgSO_4$.

A bacteriophage composition may be formulated for nasal, oral, parenteral, intra-articular, intramuscular, intravenous, subcutaneous, transdermal, ocular or aural administration. Such a bacteriophage preparation may be used directly, stored frozen in aqueous or other solution, optionally with an appropriate cryoprotectant (e.g., 10% sucrose or glycerol), stored in refrigeration temperatures, freeze dried and rehydrated prior to use, or rendered stable in some other formulation including (but not limited to) tablet, emulsion, ointment, or impregnated wound dressing or other item. In some embodiments, the bacteriophage composition may be comprised in an intravenous delivery means.

In some embodiments, the bacteriophage composition is sterile. Such a sterile product may be suitable for parenteral administration in a subject.

In some embodiments, provided herein are aerosol formulations including the bacteriophage and/or bacteriophage compositions/formulations as described herein. Some embodiments relate to methods and uses of such aerosol formulations.

In embodiments, a bacteriophage composition described herein is formulated for intravenous (IV) administration. Intravenous administration may be by intravenous push or using an IV bag.

Uses/Methods of Use

Provided herein is a use of one or more bacteriophage or a bacteriophage composition as a medicament (e.g., for treating a *Staphylococcus* infection). Corresponding methods of treating a disease comprising administration of the one or more bacteriophage or bacteriophage composition(s) to a subject are also provided. In some embodiments the treatment of illnesses/diseases as set forth in U.S. Patent Publication No. 2017-0065649 and WO 2018/146437 (incorporated herein by reference in its entirety for all of its bacteriophage, compositions, components, excipients and methods) is specifically excluded from the methods described herein. For example, in some embodiments, methods of treating pulmonary infections can be specifically excluded.

In an aspect, there is provided a bacteriophage composition for use in treating a bacterial infection. In related aspects, there is provided use of a bacteriophage composition in the manufacture of a medicament for treating a bacterial infection, as well as a method of treating a bacterial infection comprising administering the bacteriophage composition to a subject.

In an aspect, provided herein are methods of treating a bacterial infection including selecting a subject with a confirmed *Staphylococcus* infection and administering a bacteriophage composition as described herein. In one embodiment, the method comprises selecting a subject with a *Staphylococcus* infection that has not responded to treatment with one or more antibiotics.

The bacteriophage compositions are useful in treating a *Staphylococcus* (e.g. *S. aureus*) bacterial infection. In one embodiment, the bacterial infection is a sinus, nasal or respiratory infection. In one embodiment, the bacterial infection is rhinosinusitis. In one embodiment, the bacterial infection is a urinary tract infection (or complicated urinary tract infection), intra-abdominal infection (or complicated intra-abdominal infection), septicemia (e.g., septicemia due to burns, uncontrolled bacteremia), or bacteremia (e.g., due to pneumonia, urinary tract infection, endocarditis, etc). In one embodiment, the bacterial infection is an implant infection, such as a cardiac implant infection (e.g., ventricular assist device infection; pacemaker infection) or prosthetic joint infection. In one embodiment, the bacterial infection is endocarditis or prosthetic valve endocarditis. In one embodiment, the bacterial infection is a skin infection or skin structure infection. In a preferred embodiment, the bacterial infection is not a pulmonary infection. In one embodiment, the bacterial infection is a hospital or nosocomial infection.

In some embodiments, the infection is characterized by the presence of a bacterial biofilm.

In some embodiments, the subject has a bacterial infection that is not responding to one or more antibiotics. In some embodiments, the subject has a bacterial infection that is not responding to standard-of-care antibiotics.

In embodiments, one or more bacterial isolates from the subject is tested for susceptibility to the bacterial composition prior to administration.

A use or method as described herein typically comprises administering a bacteriophage composition described herein to a subject. As used herein, a "subject" is a mammal, such as a human or other animal. Preferably, the term "subject" refers to a human subject. In one embodiment, the subject is a human subject with a *Staphylococcus* infection (e.g. a *S. aureus* infection).

A bacteriophage composition may be administered to a subject in a therapeutically effective amount or a prophylactically effective amount.

As used herein, a "therapeutically effective amount" is any amount of the composition, which when administered alone or in combination to a subject for treating a bacterial infection (or a symptom thereof) is sufficient to effect such treatment of the infection, or symptom thereof.

As used herein, a "prophylactically effective amount" is any amount of the composition that, when administered alone or in combination to a subject inhibits or delays the onset or reoccurrence of a bacterial infection (or a symptom thereof). In some embodiments, the prophylactically effective amount prevents the onset or reoccurrence of a bacterial infection entirely. "Inhibiting" the onset means either lessening the likelihood of a bacterial infection's onset (or symptom thereof), or preventing the onset entirely.

An appropriate dosage range is one that produces the desired therapeutic effect (e.g., the composition is dosed in a therapeutically or prophylactically effective amount).

In one embodiment, the subject is a human subject with a *Staphylococcus* infection (e.g., a *Staphylococcus aureus* infection). In embodiments, the composition includes $1\times10^5$ to $1\times10^{11}$ PFU of each phage per ml of composition. In embodiments, the composition includes $1\times10^5$ to $1\times10^6$ PFU, $1\times10^5$ to $1\times10^7$ PFU, $1\times10^5$ to $1\times10^8$ PFU, $1\times10^5$ to $1\times10^9$ PFU, or $1\times10^5$ to $1\times10^{10}$ PFU of each phage per ml of composition. In embodiments, the composition includes $1\times10^6$ to $1\times10^7$ PFU, $1\times10^6$ to $1\times10^8$ PFU, $1\times10^6$ to $1\times10^9$ PFU, $1\times10^6$ to $1\times10^{10}$ PFU, or $1\times10^6$ to $1\times10^{11}$ PFU of each phage per ml of composition. In embodiments, the composition includes $1\times10^7$ to $1\times10^8$ PFU, $1\times10^7$ to $1\times10^9$ PFU, $1\times10^7$ to $1\times10^{10}$ PFU, or $1\times10^7$ to $1\times10^{11}$ PFU of each phage per ml of composition. In embodiments, the composition includes $1\times10^8$ to $1\times10^9$ PFU, $1\times10^8$ to $1\times10^{10}$ PFU, or $1\times10^8$ to $1\times10^{11}$ PFU of each phage per ml of composition. In embodiments, the composition includes $1\times10^9$ to $1\times10^{10}$ PFU or $1\times10^9$ to $1\times10^{11}$ PFU of each phage per ml of composition. In embodiments, the composition may include $1\times10$ PFU to $1\times10^{11}$ PFU of each phage per ml of composition. In embodiments, a bacteriophage composition is administered to a subject at a dosage of at least about $1\times10^5$ PFU of each phage, at least about $1\times10^6$ PFU of each phage, at least about $1\times10^7$ PFU of each phage, at least about $1\times10^8$ PFU of each phage, at least about $1\times10^9$ PFU of each phage, at least about $1\times10^{10}$ PFU of each phage, or at least about $1\times10^{11}$ PFU of each phage per ml of composition. In embodiments, one or more bacteriophage(s) may be combined to form a composition include $1\times10^5$, $1\times10^6$, $1\times10^7$, $1\times10^8$, $1\times10^9$ or $1\times10^{10}$, or $1\times10^{11}$ PFU of each phage per ml of composition. Dosages include any value or range within the recited ranges, including endpoints.

In some embodiments, bacteriophage compositions provided herein are administered to a subject at a dosage of at least about $1\times10^5$ PFU total phage, at least about $1\times10^6$ PFU total phage, at least about $1\times10^7$ PFU total phage, at least about $1\times10^8$ PFU total phage, at least about $1\times10^9$ PFU total phage, at least about $1\times10^{10}$ PFU total phage, or at least about $1\times10^{11}$ PFU of total phage. The bacteriophage composition is administered at a dosage of between about $1\times10^5$ to about $1\times10^{11}$ PFU of total phage per ml of composition. In embodiments, the bacteriophage composition is administered at a dosage of between about $1\times10^5$ to about $1\times10^6$ PFU, between about $1\times10^5$ to about $1\times10^7$ PFU, between about $1\times10^5$ to about $1\times10^8$ PFU, between about $1\times10^5$ to about $1\times10^9$ PFU, or between about $1\times10^5$ to about $1\times10^{10}$ PFU of total phage per ml of composition. In embodiments, the bacteriophage composition is administered at a dosage of between about $1\times10^6$ to about $1\times10^7$ PFU, between about $1\times10^6$ to about $1\times10^8$ PFU, between about $1\times10^6$ to about $1\times10^9$ PFU, between about $1\times10^6$ to about $1\times10^{10}$ PFU, or between about $1\times10^6$ to about $1\times10^{11}$ PFU of total phage per ml of composition. In embodiments, the bacteriophage composition is administered at a dosage of between about $1\times10^7$ to about $1\times10^8$ PFU, between about $1\times10^7$ to about $1\times10^9$ PFU, between about $1\times10^7$ to about $1\times10^{10}$ PFU, or between about $1\times10^7$ to about $1\times10^{11}$ PFU of each phage per ml of composition. In embodiments, the bacteriophage composition is administered at a dosage of between about $1\times10^8$ to about $1\times10^9$ PFU, between about $1\times10^8$ to about $1\times10^{10}$ PFU, or between about $1\times10^8$ to about $1\times10^{11}$ PFU of total phage per ml of composition. In embodiments, the bacteriophage composition is administered at a dosage of between about between about $1\times10^9$ to about $1\times10^{10}$ PFU, or between about $1\times10^9$ to about $1\times10^{11}$ PFU of total phage per ml of composition. In embodiments, the bacteriophage composition is administered at a dosage of between about $1\times10^{10}$ to about $1\times10^{11}$ PFU of total phage per ml of composition. A dosage may be $3\times10^9$ PFU per milliter composition. Dosages include any value or range within the recited ranges, including endpoints.

In some embodiments, the bacteriophage composition is administered at least once, twice, three times, or four times daily. Suitably the bacteriophage composition may be administered twice daily. In one embodiment, therefore, a dosage of at least about $1\times10^5$ PFU of each phage is administered at least once, twice, three times, or four times daily. In one embodiment, therefore, a dosage of at least about $1\times10^6$ PFU of each phage is administered at least once, twice, three times, or four times daily. In another embodiment at least about $1\times10^7$ PFU of each phage is administered at least once, twice, three times, or four times daily. In a further embodiment at least about $1\times10^8$ PFU of each phage is administered at least once, twice, three times, or four times daily. In another embodiment at least about $1\times10^9$ PFU of each phage is administered at least once, twice, three times, or four times daily. In another embodiment at least about $1\times10^{10}$ PFU of each phage is administered at least once, twice, three times, or four times daily. In another embodiment at least about $1\times10^{11}$ PFU of each phage is administered at least once, twice, three times, or four times daily. A dosage range between about $1\times10^5$ PFU of each phage to about $1\times10^{11}$ PFU of each phage may be administered at least once, twice, three times, or four times daily. Preferably a dosage range between about $1\times10^7$ PFU of each phage to about $1\times10^9$ PFU of each phage may be administered at least once, twice, three times, or four times daily.

In some embodiments, the bacteriophage composition is administered every 2 hours, every 4 hours, every 6 hours, every 8 hours, every 12 hours, every 24 hours, every 48 hours, or every 72 hours. In some embodiments, the bacteriophage composition is administered every 2 hours. In some embodiments, the bacteriophage composition is administered every 4 hours. In some embodiments, the bacteriophage composition is administered every 6 hours. In some embodiments, the bacteriophage composition is administered every 8 hours. In some embodiments, the bacteriophage composition is administered every 12 hours. In some embodiments, the bacteriophage composition is administered every 24 hours. In some embodiments, the bacteriophage composition is administered every 48 hours. In some embodiments, the bacteriophage composition is administered every 72 hours. Frequency of administration include any value or range within the recited ranges, including endpoints.

In some embodiments, the bacteriophage composition is administered for at least one day, at least 2 days, at least 3 days, at least 4 days, at least 5 days, at least 6 days, one week, at least two weeks, at least three weeks, at least four weeks, at least 5 weeks, at least 6 weeks, at least 7 weeks, at least 8 weeks, at least 9 weeks, at least 10 weeks, or more than 10 weeks. In some embodiments, the bacteriophage composition is administered for at least one day. In some embodiments, the bacteriophage composition is administered for at least one week. In some embodiments, the bacteriophage composition is administered for at least two weeks. In some embodiments, the bacteriophage composition is administered for at least three weeks. In some embodiments, the bacteriophage composition is administered for at least four weeks. In some embodiments, the bacteriophage composition is administered for at least five weeks. In some embodiments, the bacteriophage composition is administered for at least six weeks. In some embodiments, the bacteriophage composition is administered for between about 3 days and about 100 days. In an embodiment, the bacteriophage composition is administered for between about 7 days and about 60 days. In an embodiment, the bacteriophage composition is administered for between about 14 days and about 30 days. In an embodiment, the bacteriophage composition is administered for between about 3 days and about 28 days. In an embodiment, the bacteriophage composition is administered for at least 14 days. In an embodiment, the bacteriophage composition is administered for greater than 14 days. Duration of administration includes any value or range within the recited ranges, including endpoints.

A bacteriophage composition for use as a medicament may be administered by any route selected on the basis of the condition to be treated. In one embodiment the route of administration is nasal, oral, pulmonary, parenteral, intramuscular, intra-articular, intravenous, subcutaneous, transdermal, ocular, aural or combinations thereof. When used in the treatment of a pulmonary bacterial infection, the bacteriophage composition may be administered nasally or orally, for example via aerosolisation or nebulization using an appropriate pulmonary delivery means, such as an inhaler, nebulizer, or respirator. The composition may be administered to the patient via more than one route, for example intravenously and by inhalation, or intravenously and intra-articularly.

In one embodiment an antibiotic (suitably a chemical antibiotic) may be administered in combination with the bacteriophage composition. Combinatorial administration of antibiotics and bacteriophages is taught in WO 2008/110840 and WO 2005/009451, which teaching is incorporated herein by reference in its entirety for all of its compositions, bacteriophage, components/excipients and methods. The antibiotic may be administered simultaneously or sequentially with the bacteriophage composition. Suitably, the one or more antibiotics may be administered after the composition such that bacteriophage replication has become established before antibiotic treatment begins. In this case, antibiotic treatment may be delayed for one or more hours or days from application of the one or more bacteriophages, e.g., from 1 to 2, 3, 4, 5, 6, 7, 8, 9 or 10 days. Where a bacteriophage composition comprising a plurality of bacteriophages is employed with each member of the composition exhibiting different strain specificity, it will suffice that at least a proportion (e.g., one or more bacteriophage(s)) of the composition is capable of targeting the bacterial infection.

Thus, in some embodiments a bacteriophage composition comprises one or more antibiotics, such as one or more chemical antibiotics. An antibiotic may be selected based on sensitivity of a *Staphylococcus* species or strain to said antibiotic. The antibiotic(s) include antibiotics selected from a class of antibiotics including fluoroquinolone, carbapenem, aminoglycoside, ansamycin, cephalosporin, penicillin, beta lactam, beta lactamase inhibitor, folate pathway inhibitor, fucidane, glycopeptide, glycylcycline, lincosamide, lipopeptide, macrolide, oxazolidinone, phenicol phosphonic acid, streptogramin, or tetracycline. In some embodiments, one or more of the above antibiotics can be specifically excluded from the compositions and methods herein. In some embodiments, the antibiotic can be used as a co-treatment that is not part of the same composition. Suitably the *Staphylococcus* species or strain may be the same species or strain present in a subject to be treated. In one embodiment a *Staphylococcus* species or strain is taken from a subject to be treated and tested for antibiotic sensitivity. Sensitivity may be determined by in vitro sensitivity assays known in the art.

Alternatively or additionally, an antibiotic may be selected because it is known to be active against a bacteria known to be (or thought likely to be) present together with a *Staphylococcus* infection to be treated (e.g., as part of a bacterial biofilm).

In one embodiment an antibiotic is one or more selected from: vancomycin, teicoplanin, penicillin, methicillin, flucloxacillin, dicloxacillin, cephalosporins (e.g., cefazolin, cephalothin, cephalexin), clindamycin, lincomycin, erythromycin, or combinations thereof. Suitably the antibiotic may be vancomycin and/or teicoplanin. In some embodiments, one or more of the above antibiotics can be specifically excluded from the compositions and methods herein.

Provided herein are uses or methods including administration of a bacteriophage composition to a subject in vivo; in vitro monitoring of the sensitivity of a sample of bacterial cells from an infection (e.g. present in the subject) or from another infection by the same strain to one or more antibiotic(s); and administration of said one or more antibiotic(s), when it has been established that said sensitivity to said one or more antibiotic(s) has been induced.

In an embodiment, provided herein is a method for restoring sensitivity to an antibiotic(s) by administering a composition as described herein. In embodiments. provided is a method for disrupting a biofilm by administering a composition as described herein. In an embodiment is provided a method for destroying a biofilm by administering a composition as described herein.

In an embodiment, the antibiotic (e.g. chemical antibiotic) is administered at a time period at which sensitivity of sampled bacteria to the antibiotic is induced by the composition. In some embodiments, the time period may be 6 hours, 12 hours, 24 hours, or 48 hours. In other embodiments, the bacteriophage composition and the antibiotic may be administered at intervals of one day to two months apart, preferably at intervals of one to four weeks apart, suitably at intervals of two weeks apart.

In one embodiment is provided a method for restoring sensitivity to an antibiotic(s) by administering a composition as described herein. In one embodiment is provided a method for disrupting a biofilm by administering a composition as described herein. In one embodiment is provided a method for destroying a biofilm by administering a composition as described herein.

In one embodiment a bacteriophage composition may be used in a method of killing *Staphylococcus* (e.g., *S. aureus*) bacteria on a surface, said method comprising applying a bacteriophage composition (e.g., formulated as a disinfectant composition) to the surface. Suitably, the surface is a site of contamination or prospective site of contamination.

In one embodiment, the surface is the skin of a mammal (e.g., a human). Alternatively or additionally, the surface may be equipment (suitably medical equipment), bedding, furniture, walls or floors (e.g., in a clinical environment).

Some aspects relate to, for example, a kit comprising: a bacteriophage composition; and instructions for use of same (e.g., in medicine). The kit may further comprise an antibiotic (e.g., a chemical antibiotic) and optionally instructions for use of same in combination with the bacteriophage composition.

In one embodiment, the instructions provide details for dosing a bacteriophage composition as described herein. In one embodiment, the instructions included in a kit are for use of in treating a *Staphylococcus* infection.

Some aspects relate to, for example, use of a bacteriophage composition or kit for non-medical applications. For example, a bacteriophage composition or kit may be used in food hygiene, agriculture or crop protection, and/or in environmental hygiene applications. Thus, in one embodiment the kit comprises instructions for use of a bacteriophage composition in a non-medical application.

A bacteriophage composition may also be comprised in a bandage or wound dressing. The wound dressing may be a pad or sticking plaster-type dressing. The bacteriophages may be applied to the wound dressing or bandage as a disinfectant formulation or topical cream, prior to applying to the wound dressing or bandage. Alternatively, the wound dressing or bandage may be soaked in a carrier containing the bacteriophages and dried to impregnate said bacteriophages within the dressing or bandage. Bacteriophages may also be adsorbed onto the surface of the bandage or wound dressing using techniques generally known in the art. The advantage of this approach is that the bandage or wound dressing allows the bacteriophages to be brought into contact with a wound, which may contain the bacteria. One aspect relates to, for example, methods of inhibiting or treating bacteria by applying a bandage or wound dressing to a subject.

The bacteriophage composition is particularly advantageous for use in medicine, and shows clinical efficacy in the treatment of *Staphylococcus* infections.

Additionally, the bacteriophage composition is efficacious against a broad spectrum of *Staphylococcus* species and strains.

A combination of a bacteriophage composition and an antibiotic (e.g., a chemical antibiotic) may provide an enhanced (e.g., synergistic) therapeutic over the antibiotic therapy alone.

Unless defined otherwise, all technical and scientific terms used herein have the same meaning as commonly understood by one of ordinary skill in the art to which this disclosure belongs.

This disclosure is not limited by the example methods and materials disclosed herein, and any methods and materials similar or equivalent to those described herein can be used in the practice or testing of embodiments of this disclosure. Numeric ranges are inclusive of the numbers defining the range. The headings provided herein are not limitations of the various aspects or embodiments of this disclosure which can be had by reference to the specification as a whole. Accordingly, the terms defined immediately below are more fully defined by reference to the specification as a whole.

Other definitions of terms may appear throughout the specification. Before the example embodiments are described in more detail, it is to be understood that this disclosure is not limited to particular embodiments described, as such may, of course, vary. It is also to be understood that the terminology used herein is for the purpose of describing particular embodiments only, and is not intended to be limiting, since the scope of the present disclosure will be limited only by the appended claims.

Where a range of values is provided, it is understood that each intervening value, to the tenth of the unit of the lower limit unless the context clearly dictates otherwise, between the upper and lower limits of that range is also specifically disclosed. Each smaller range between any stated value or intervening value in a stated range and any other stated or intervening value in that stated range is encompassed within this disclosure. The upper and lower limits of these smaller ranges may independently be included or excluded in the range, and each range where either, neither or both limits are included in the smaller ranges is also encompassed within this disclosure, subject to any specifically excluded limit in the stated range. Where the stated range includes one or both of the limits, ranges excluding either or both of those included limits are also included in this disclosure.

The publications discussed herein are provided solely for their disclosure prior to the filing date of the present application. Nothing herein is to be construed as an admission that such publications constitute prior art to the claims appended hereto. All publications referenced herein are incorporated herein by reference in their entireties for all of their teachings, including, but not limited to, all bacteriophage, compositions, components, excipients, and methods.

EXAMPLES

Example 1: Assembly of a 3 Phage Bacteriophage Composition

Experiments were conducted to create a bacteriophage therapy that met the following criteria: 1) Obligately lytic, to avoid specialized transduction of bacterial genes; 2) Not known, by empirical testing and/or inference from genomics, to be prone to generalized transduction, and 3) Fully sequenced, to avoid phages with genes known to carry antibiotic resistance or bacterial virulence genes, and to help assess other lifestyle traits.

Collectively, the phages used together to treat a patient should: 1) Have broad activity against the target pathogen but not other species, to maximize potential utility and minimize off-target effects, and 2) Be capable of complementation, in which resistant mutants arising to one phage are sensitive to another phage.

In addition to characteristics of the phages themselves, material for clinical use should be produced in such a way as to give confidence that the final product retains these characteristics (i.e. are still the same phages) and does not contain potentially harmful (or harmful amounts) of impurities such as endotoxin or host cell proteins.

Each of the selected phages was isolated from an environmental source and subsequently paired to a well-characterized S. aureus strain that serves as its manufacturing host. After passaging and iterative selection, candidate phages were selected. The genomic sequences of these are not the same as the original, naturally-occurring sequence. Host-paired phages were purified to ensure that the resulting master stocks produced genetically and phenotypically consistent batches of each phage. Unless otherwise stated, all data is derived from the host-paired, plaque-purified phages. Phages were propagated in liquid culture using vegetable peptone media (VP0101, Oxoid, UK). Lysates were passed through a 0.2 µm filter to remove large cellular debris and, depending on the needs of subsequent testing, optionally subjected to a proprietary process of column-based purification steps to further remove host cell proteins and other bacterial debris and to replace growth medium with phosphate-buffered saline (PBS) containing 10 mM magnesium sulfate (PBS+Mg). Equal concentrations of each bacteriophage were combined to form the bacteriophage cocktail (known as AB-SA01). The bacteriophage are genetically consistent throughout storage and production processes.

Bacteria: AB-SA01 manufacturing hosts are S. aureus strains originally isolated from humans. The S. aureus diversity panel and the species-specificity panel were sourced from the American Type Culture Collection (Manassas, USA), the Walter Reed Army Institute of Research Multidrug-resistant Organism Repository and Surveillance Network ("MRSN", Silver Spring, USA), and clinical sites in Australia and the UK. Global surveillance panels of S. aureus strains were obtained from JMI Laboratories (North Liberty, USA). Targeted interest panels include chronic rhinosinusitis (CRS) strains from Belgium, and vancomycin intermediate (VISA) strains from the Centers for Disease Control (CDC) and Food and Drug Administration (FDA) Antimicrobial Resistance Isolate Bank (Atlanta, USA). The definitions of multidrug resistant (MDR) and extensively drug resistant (XDR) strains are according to Magiorakos et al (Clin Microbiol Infect 18(3): 268-281, 2012).

Phage sensitivity assays: Testing on the S. aureus panels used Heart Infusion Broth, amended with 1.5% agar for plates or 0.7% agar for overlays. Phage activity was assessed using a modification of the small drop agar overlay method (Mazzocco et al, Methods Mol Biol. 2009; 501:81-5, 2009). Briefly, 100 µL of 16-18 h planktonic bacterial culture was mixed with molten 0.7% top agar and poured evenly over an agar plate. When the top agar layer was set, serial dilutions of standardized phage solutions were spotted onto the overlay and plates incubated overnight at 37° C. Phage activity was indicated by clearing of the bacterial lawn at the site of phage application, and by the development of individual plaques as the phage sample is diluted. Strains were only considered sensitive if discrete plaques could be observed as the sample was diluted, indicating phage replication. Testing on the species-specificity panel was conducted similarly, using media recommended for the specific bacterial species and bacterial culture volumes suitable to produce a uniform lawn.

Frequency of resistance and complementation: Complementation studies conducted during product selection used apparent bacteriophage insensitive mutant (BIM) colonies that were isolated after infecting a sensitive S. aureus strain with individual candidate phages. Colonies were streak-purified on agar plates. To screen for phage sensitivity, 10 µL spots of PBS or phage (~1×10$^9$ PFU/mL; PFU: plaque forming units) were spotted onto Nutrient Agar plates. After 10 min, 5 µL of overnight Nutrient Broth culture from each BIM or the parental strain was applied to each phage spot. After 24 h incubation at 37° C., phage+bacteria spots were compared to PBS+bacteria controls and scored as R (resistant; no difference from control spot), I (intermediate, phage activity seen within bacterial spot), or S (sensitive, <10 bacterial colonies in spot). For the final AB-SA01 composition, the frequency of spontaneous phage resistance in triplicate populations of the same S. aureus strain was assessed using a modification of O'Flynn et al (2004 Appl Environ. Microbio. 70(6):3417-3424). In 200 µL, 6-8×10$^8$ CFU (colony forming units) was mixed with 2-3×10$^9$ PFU of purified phage (AB-SA01 or individual components), incubated for 10 min at 37° C., then mixed with 3 mL molten 0.4% Nutrient Agar and poured over a 10 mm round 1.5% Nutrient Agar plate. Bacterial colonies were counted after 24 h and 48 h incubation at 37° C. The apparent frequency of BIMs was calculated as the number of colonies on each test plate divided by the input number of bacteria in that replicate. Results were compared using a repeated measures ANOVA and a priori planned comparisons between AB-SA01 and the 3 component phages were conducted using paired t-tests. Up to 10 BIMs from each phage+host combination (all BIMs if <10) were streak-purified on agar plates and tested for the presence of heritable resistance using the spot dilution method of phage sensitivity testing.

Genome sequencing and analysis: Phage genomic DNA was purified from filtered lysates or purified preparations and sequenced by Illumina paired-end (ACGT) or PacBio technologies (Expression Analysis), using FOR-free libraries. Annotation was conducted using myRAST. Similarities of annotated proteins to integrases and annotated genes to bacterial virulence or antibiotic resistance genes were assessed using blast searches requiring at least 30% identity across 50% of the sequence, and E≤0.05, any hits were manually inspected for validity based on factors such as the likely accuracy of the hit's original annotation and evidence from secondary structure predicted by HHPred (Soding et al. 2005, Bioinformatics. 21(7):951-960; Soding et al. 2005, Nucl. Acid Res. 33(suppl 2):W244-W248, 2005). Genome alignments were constructed using Progressive Mauve with the default parameters (Darling et al. 2004, Genome Res 14(7):1394-1403).

Animal studies: Purified phage material was used for all animal studies. AB-SA01: Three groups of five female BALB/c mice were anesthetized and an inoculum of $3.0 \times 10^8$ CFU of methicillin-sensitive S. aureus strain Xen29 (Perkin Elmer) was delivered intranasally (IN) in a volume of 35 µL. At 2 and 6 hours post infection (hpi), untreated controls received 50 µL PBS—Mg IN and the phage treatment group received $5 \times 10^8$ PFU per phage in a 50 µL IN dose. At 2, 6, and 12 hpi, the antibiotic controls received 110 mg/kg vancomycin as a SC injection. At 24 hpi, mice were euthanized by $CO_2$ inhalation and lungs processed for bacterial titers. Bacterial counts were enumerated on Mueller Hinton agar and the treatment groups compared to the control using ANOVA on $log_{10}$-transformed values with Dunnett's test multiple comparisons to control. After both mouse studies, bacteria recovered from mouse lung tissue were tested for phage sensitivity as previously described.

Physicochemical characteristics of AB-SA01 component phages: All three AB-SA01 component phages produce small, clear plaques when plated on their paired S. aureus hosts. Transmission electron microscopy (TEM) images of the three AB-SA01 component phages show the straight, contractile tail and narrow neck that are characteristic of phages belonging to the order Caudovirales, family Myoviridae (FIG. 1).

Figure 2:
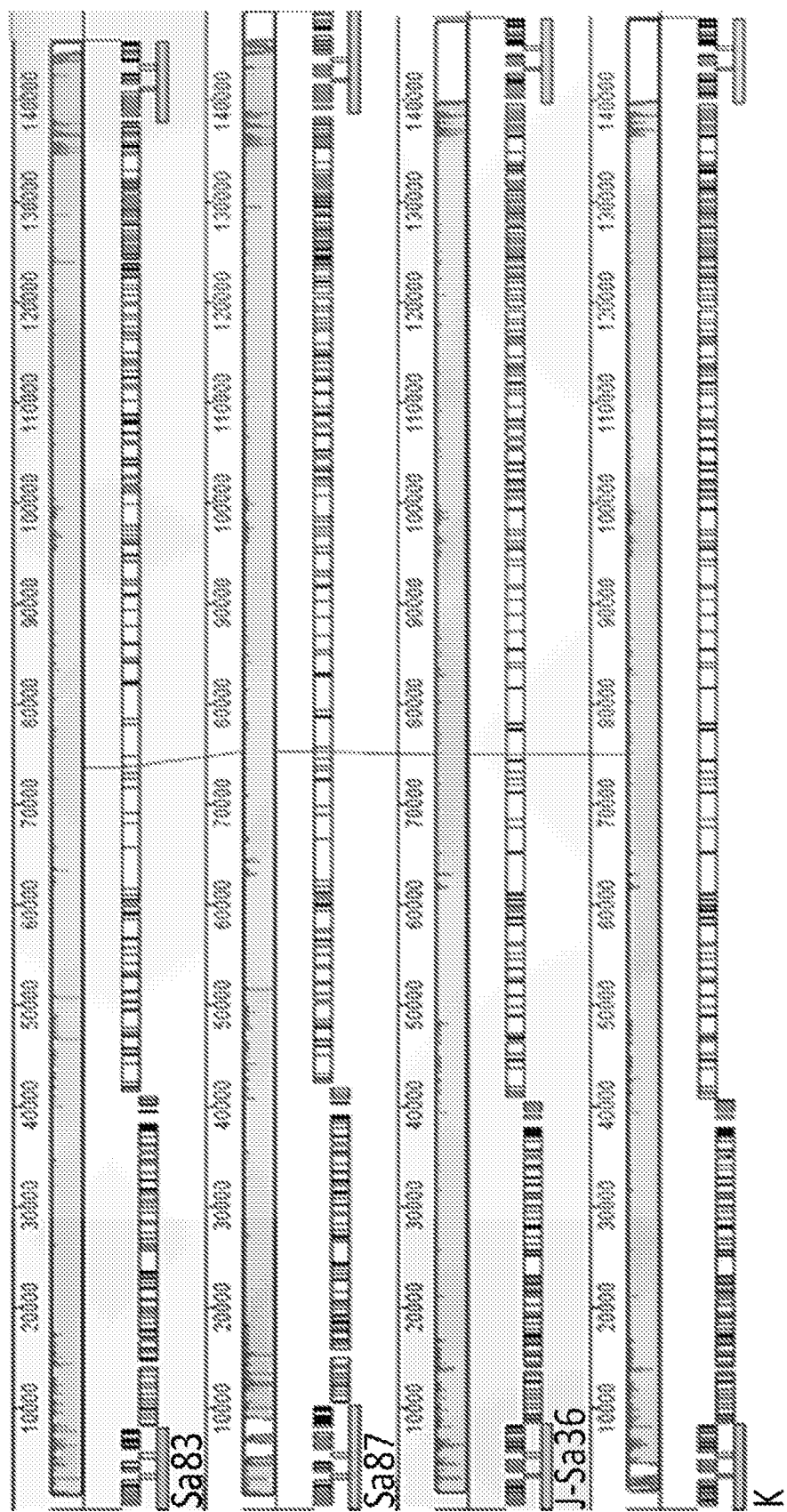
FIG. 2 shows a Progressive Mauve alignment of (top to bottom) Sa83, Sa87, J-Sa36, and phage K (GenBank Accession No. K766114), each showing annotated genes (white boxes) and long terminal repeats (red boxes). Interruptions in the red blocks above each annotated genome indicate differences in nucleotide sequences.
Figure 3B:
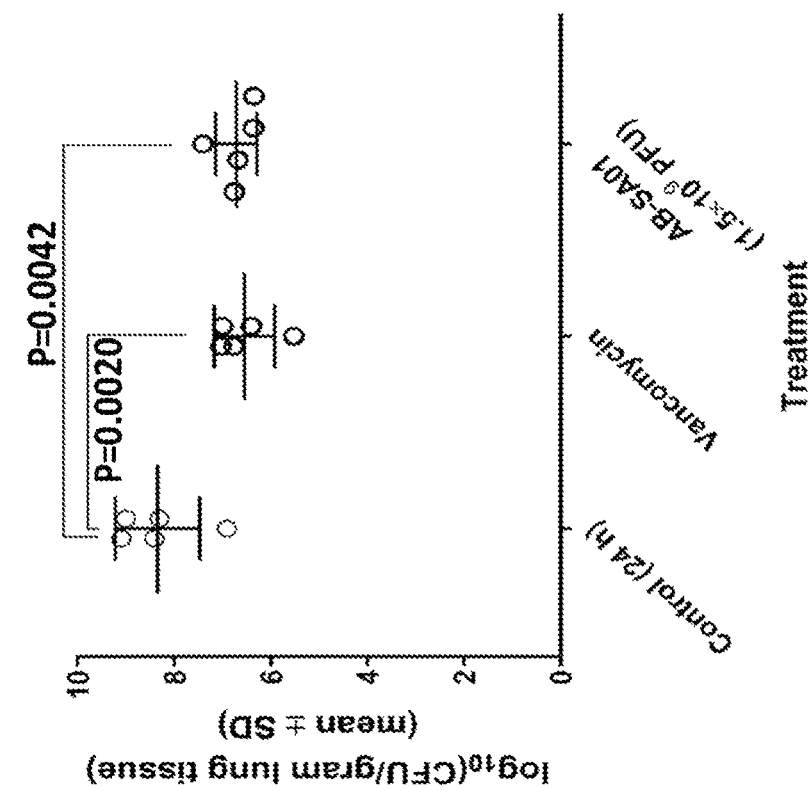
FIGS. 3A and 3B are graphs showing a composition of phage according to one or more aspects described herein (AB-SA01) reduces lung bacterial burden in neutropenic CD-1 mice (2A) and immunocompetent BALB/c mice (2B). Phage doses are given as total PFU per dose.
Figure 3A:
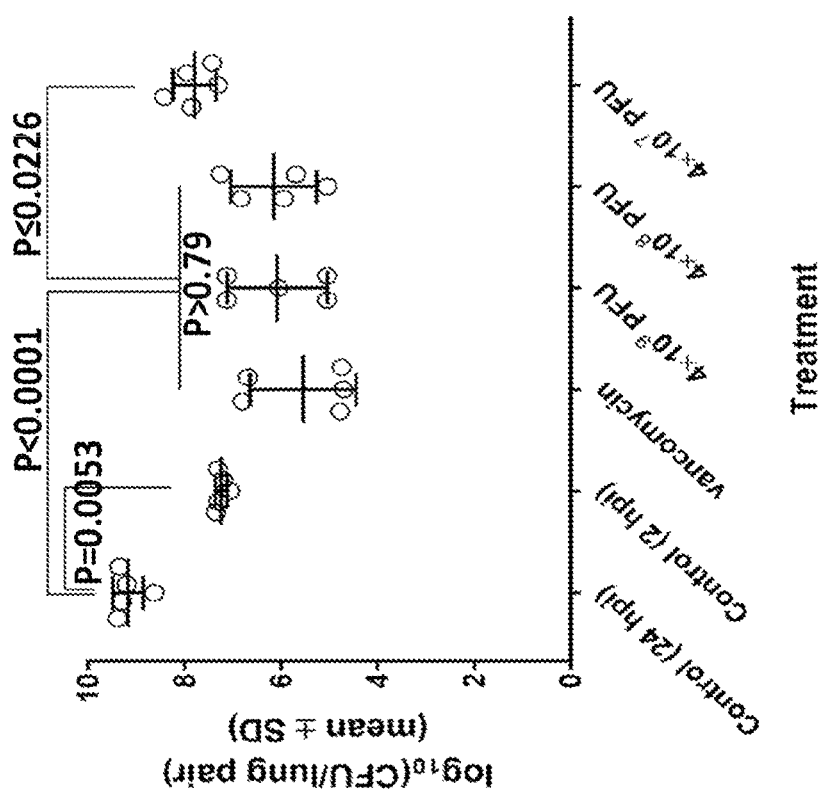

All AB-SA01 component phages were sequenced from amplification-free libraries capable of revealing the relative frequencies of genome regions. Read-mapping data showed regions of approximately doubled coverage identifying the genome termini and associated fixed direct terminal repeats between approximately 8 and 10 kb. This genome structure indicates a sequence-specific packaging mechanism not associated with generalized transduction. The pairwise relatedness of the collinear single-copy component phage genomes ranges from 93 to 97% nucleotide identity (FIG. 2) and all are related to well-studied S. aureus myovirus phage K. No identifiable integrases were found in the AB-SA01 component phage genomes and none of the ca. 200 predicted phage genes in each of the three phages were similar to known bacterial virulence or antibiotic resistance genes.

In Vitro Activity of AB-SA01

The target species for AB-SA01 is S. aureus. Overall, 94% of 401 clinical S. aureus isolates were sensitive to AB-SA01 (Table 1), including 95% of the 205 isolates known to be MDR, and with little apparent variation by genetic lineage, year of isolation, or infection type. When tested on representatives of normal human microflora and related staphylococci, AB-SA01 and its component phages showed some activity against two of five tested S. epidermidis strains, but no cross-genus activity (Table 2). When tested on S. aureus strains, no evidence of interference among the component phages was observed. The titers observed for AB-SA01 were mostly consistent with the component phage activities, with a few cases of possible synergy in which AB-SA01 generated plaques even though none of the component phages did. In addition, bacteriophage that have less than 10% nucleic acid variation across the entire genome when compared to any one of Sa87, J-Sa36, or Sa83 were tested against seven S. aureus isolates. Representative data for two phage is shown in Table 3.

The AB-SA01 component phages were selected partly based on the 68-member diversity panel, which includes representatives of all major community-acquired (CA-) and hospital-acquired (HA-) MRSA lineages (Stefani et al. 2012, Int J Antimicrob Agents 39(4): 273-282; Otter et al. 2010, Lancet Infect Dis 10(4): 227-239). Each component phage had a different host range, with most bacterial strains being sensitive to more than one of the AB-SA01 phages. AB-SA01 activity was similarly high across panels of isolates that represent globally prevalent S. aureus from blood, wound, lung, urinary and other infections in later years. Using targeted interest panels, AB-SA01 was also shown to have activity on strains having the relatively rare but concerning VISA phenotype, a panel of exclusively CRS isolates, and a variety of the clinically significant USA300 lineage.

TABLE 1

Phage activity against S. aureus

| Panel Type | Phage Panel | Percentage of Isolates Sensitive to Indicated Phage | | | |
|---|---|---|---|---|---|
| | | Sa83 | Sa87 | J-Sa36 | AB-SA01 |
| Selection | AmpliPhi Reference Panel (n = 68) [1] | 85.2% | 86.8% | 76.4% | 94.1% |
| Prevalence [2] | 2013 Global Panel (n = 53) | 96.2% | 96.2% | 86.8% | 100% |
| | 2015 Global Panel (n = 60) | 85.0% | 93.3% | 75.0% | 93.3% |
| | 2016 Global Panel (n = 60) | 80.0% | 83.3% | 63.3% | 88.3% |
| Targeted | CDC VISA Panel (n = 14) | 64.3% | 64.3% | 64.3% | 64.3% |
| | Regional USA300 Panel (n = 29) [3] | 100% | 100% | 100% | 100% |
| | Ghent CRS Panel (n = 90) | NT | NT | NT | 96.7% |

TABLE 1-continued

Phage activity against *S. aureus*

| Panel Type | Phage Panel | Percentage of Isolates Sensitive to Indicated Phage | | | |
|---|---|---|---|---|---|
| | | Sa83 | Sa87 | J-Sa36 | AB-SA01 |
| NA | Expanded Access Requests (n = 27) [4] | 85.2% | 92.6% | 88.9% | 96.3% |
| | Summary Values | Diversity Panels: Selection & Prevalence (n = 241) | | | 93.8% |
| | | All Panels (n = 401) | | | 94.0% |

TABLE 2

In vitro activity of AB-SA01 and its component phages on bacterial species other than *S. aureus*

| Bacteria | No. Strains Tested | No. Strains Productively Infected | | | |
|---|---|---|---|---|---|
| | | Sa83 | Sa87 | J-Sa36 | AB-SA01 |
| *Achromobacter xylosoxidans* | 1 | 0 | 0 | 0 | 0 |
| *Acinetobacter baumanii* | 1 | 0 | 0 | 0 | 0 |
| *Burkholderia cepacia* | 1 | 0 | 0 | 0 | 0 |
| *Corynebacterium* spp. | 4 | 0 | 0 | 0 | 0 |
| *Enterobacter cloacae* | 1 | 0 | 0 | 0 | 0 |
| *Escherichia coli* | 1 | 0 | 0 | 0 | 0 |
| *Klebsiella pneumoniae* | 1 | 0 | 0 | 0 | 0 |
| *Micrococcus luteus* | 1 | 0 | 0 | 0 | 0 |
| *Pantoea agglomerans* | 1 | 0 | 0 | 0 | 0 |
| *Pseudomonas aeruginosa* | 3 | 0 | 0 | 0 | 0 |
| *Pseudomonas oryzihabitans* | 1 | 0 | 0 | 0 | 0 |
| *Staphylococcus epidermidis* | 5 | 2 | 2 | 2 | 2 |
| *Stenotrophomonas maltophilia* | 1 | 0 | 0 | 0 | 0 |
| *Streptococcus* spp. | 3 | 0 | 0 | 0 | 0 |

TABLE 3

Phage activity of Sa76 and Sa81 against *S. aureus* isolates

| | Sensitivity (S) or Resistance (R) of *S. aureus* Isolates | | | | | | |
|---|---|---|---|---|---|---|---|
| Phage | SPS#625 | SPS#626 | SPS#627 | SPS#628 | SPS#629 | SPS#745 | SPS#746 |
| Sa76 | S | S | R | S | R | S | R |
| Sa81 | S | S | R | S | R | S | S |

Frequency of Resistance and Complementation.

The potential for phages to complement each other in the event that bacterial resistance arises was considered as part of AB-SA01 development. Six candidate phages with broad or differing host ranges were assessed on a sensitive *S. aureus* strain. BIMs that were generated using one phage were first tested to confirm whether they truly exhibited reduced phage sensitivity after streak-purification, then cross-resistance to other phages was tested by the same method (Table 4). Sa83, Sa81, and Sa76 were similarly able to complement Sa87-induced resistance and had previously shown very similar host ranges, therefore only Sa83 was retained as part of AB-SA01. J-Sa37 more often exhibited cross-resistance than complementation and was not included in AB-SA01. J-Sa36 exhibited different complementation behavior than either Sa87 or Sa83.

TABLE 4

Complementation among candidate phages

| Phage used to generate BIM | Bacterial Lawn | BIM Confirmation[1] | Test for Complementation | | | | | |
|---|---|---|---|---|---|---|---|---|
| | | | Sa83 | Sa87 | J-Sa36 | Sa76 | Sa81 | J-Sa37 |
| Sa87 | parental | S | S | S | S | S | S | S |
| | BIM 1 | I | S | — | S | S | S | R |
| | BIM 2 | I | S | — | S | S | S | R |
| | BIM 3 | S[2] | — | — | — | — | — | — |

TABLE 4-continued

Complementation among candidate phages

| Phage used to generate BIM | Bacterial Lawn | BIM Confirmation[1] | Test for Complementation | | | | | |
|---|---|---|---|---|---|---|---|---|
| | | | Sa83 | Sa87 | J-Sa36 | Sa76 | Sa81 | J-Sa37 |
| | BIM 4 | I | S | — | S | S | S | R |
| | BIM 5 | I | S | — | I | S | S | R |
| | BIM 6 | I | S | — | S | S | S | R |
| | BIM 7 | I | S | — | S | S | S | R |
| | BIM 8 | I | S | — | I | S | S | R |
| | BIM 9 | I | S | — | I | S | S | R |
| | BIM 10 | I | S | — | I | S | S | R |
| J-Sa36 | Parental | S | S | S | S | — | — | S |
| | BIM 1 | I | S | I | — | — | — | R |
| | BIM 2 | I | I | I | — | — | — | R |
| | BIM 3 | I | I | S | — | — | — | S |
| | BIM 4 | I | I | I | — | — | — | S |

S = sensitive;
I = intermediate;
R = resistant
[1]BIM confirmation conducted using same phage as in column 1. R: resistant (no inhibition of bacterial growth), I: intermediate (phage activity seen within bacterial spot), S: sensitive (<10 colonies within bacterial spot), —: not tested
[2]BIM was not recovered during streak purification therefore concluded to be sensitive; no other testing possible After AB-SA01 composition was finalized, the mean apparent frequency of resistance to AB-SA01 was lower than the values observed for the individual phages, both at 24 h and 48 h (Table 5). However, this trend was not statistically significant (P>0.05), possibly because the values observed in this study were close to the limit of detection. This suggests that the spontaneous frequency of AB-SA01 resistance among sensitive *S. aureus* populations is no greater than about $3 \times 10^{-9}$. This number is produced by dividing the number of observed bacterial colonies by the total number of bacterial cells initially present. None of the BIM colonies observed in this study could be isolated by re-streaking on agar plates, implying that their growth on the test plates was not due to stable, heritable resistance, but was instead a temporary phenotype or a spatial phenomenon in which cells escapes contact with the phages during incubation of the phage-bacteria mixture before plating.

TABLE 5

Apparent frequency of intrinsic phage resistance in populations of *S. aureus* sensitive to AB-SA01 and its component phages

| | After 24 h plate incubation | | | After 48 h plate incubation | | |
|---|---|---|---|---|---|---|
| Phage | Replicate 1[1] | Replicate 2 | Replicate 3 | Replicate 1 | Replicate 2 | Replicate 3 |
| Sa83 | 1.1E−8 | 3.8E−9 | 5.0E−9 | 7.1E−9 | 3.8E−9 | 6.7E−9 |
| Sa87 | 2.0E−8 | 5.0E−9 | 5.0E−9 | 1.7E−8 | 5.0E−9 | 5.0E−9 |
| J-Sa36 | 2.9E−9 | 2.5E−9 | 1.2E−8 | 2.9E−9 | 1.3E−9 | 5.0E−9 |
| AB-SA01[2] | 1.4E−9 | 3.8E−9 | 3.3E−9 | 2.9E−9 | 0[3] | 3.3E−9 |

Example 2: Bacteriophage Administration to Human Patients

Bacteriophage cocktails were administered to human patients having *Staphylococcus aureus* infections that did not respond to antibiotic treatment alone. The patients were suffering from bacteremia, endocarditis (native valve), prosthetic valve endocarditis, or ventricular assist device infection.

A bacteriophage cocktail, containing approximately equal ratios of three bacteriophage, Sa87, J-Sa36, Sa83 (see U.S. Patent Pub. No. 2017/0065649, which is incorporated herein by reference in its entirety), was administered to four of the patients having *S. aureus* infections. The phage cocktail had approximately 96% coverage of *S. aureus* strains, including multidrug-resistant isolates. Susceptibility of *S. aureus* isolates from the patients was determined by soft agar overlay small drop assay prior to treatment. Patients were treated with $3 \times 10^9$ PFU of the phage cocktail via intravenous administration every 12 hours. Therapy was administered for 3 to 14 days, depending on indication. Patients were also administered the best available antibiotic therapy, as determined by the attending physician.

Results showed treatment success in 75% of patients (three) in the modified intent-to-treat population (mITT, defined as all patients who meet criteria for the clinical diagnosis, whose bacterial isolate was susceptible to AB-SA01 and who received at least one dose of AB-SA01) treated with AB-SA01 by end of therapy (determined by the treating physician as a complete resolution or significant improvement of baseline signs and symptoms). Treatment was well-tolerated and there were no treatment-related serious adverse events. All but one of the treated patients showed complete resolution or significant improvement of baseline signs and symptoms.

Ninety (90) doses of AB-SA01 was administered. Throughout the duration of treatment, the bacterial isolates from the patients remained sensitive to the cocktail.

Example 3: Bacteriophage Administration in Human Patients

Bacteriophage cocktails were administered to human patients having *S. aureus* infections that did not respond to antibiotic treatment alone. The patients were suffering from *S. aureus* infections, including bacteremia and septicemia, endocarditis (native valve), prosthetic valve endocarditis, osteomyelitis, ventricular assist device (VAD) infection, prosthetic joint infection, or chronic rhinosinusitis.

A bacteriophage composition "cocktail", containing approximately equal ratios of three bacteriophage, Sa87, J-Sa36, Sa83 (see U.S. Patent Pub. No. 2017/0065649, which is incorporated herein by reference in its entirety), was administered to fifteen (15) patients having *S. aureus* infections. The phage cocktail had approximately 96% coverage of *S. aureus* strains, including multidrug-resistant isolates. Susceptibility of *S. aureus* isolates from the patients was determined by soft agar overlay small drop assay prior to treatment. Patients were treated with $3 \times 10^9$ PFU of the phage cocktail via intravenous, intra-articular or instrasinal administration every 12 hours or once. Therapy was administered for 3 to 28 days, depending on indication. Patients were also administered the best available antibiotic therapy, as determined by the attending physician.

Results showed treatment success in 85% of patients (eleven) in the modified intent-to-treat population (mITT, defined as all patients who meet criteria for the clinical diagnosis, whose bacterial isolate was susceptible to AB-SA01 and who received at least one dose of AB-SA01) treated with AB-SA01 by end of therapy (determined by the treating physician as a complete resolution or significant improvement of baseline signs and symptoms). One patient showed improvement (7.5%) ("improvement" was determined by the treating physician as a clinically meaningful improvement of baseline signs and symptoms). One patient showed no improvement after treatment with AB-SA01 ("no improvement" was determined by the treating physician as no resolution of baseline signs and symptoms, or death).

Over 400+ doses of AB-SA01 were administered, including 300+ doses intravenously, 2 intra-articular, and 50+ intra-sinal. Treatment was well tolerated in all patients. There were no treatment-related SAEs.

All publications mentioned in the above specification are herein incorporated by reference. Various modifications and variations of the described methods and system of the present invention will be apparent to those skilled in the art without departing from the scope and spirit of the present invention. Although the present invention has been described in connection with specific preferred embodiments, it should be understood that the invention as claimed should not be unduly limited to such specific embodiments. Indeed, various modifications of the described modes for carrying out the invention which are obvious to those skilled in biochemistry and biotechnology or related fields are intended to be within the scope of the claims.

EMBODIMENTS

Embodiment 1-1. A method of treating a bacterial infection in a subject comprising administering to the subject a bacteriophage composition comprising one or more bacteriophages selected from Sa87, J-Sa36, Sa83, and mutants thereof, wherein the bacterial infection comprises *Staphylococcus*.

Embodiment 1-2. The method of embodiment 1-1, said composition comprising at least two bacteriophages selected from Sa87, J-Sa36, Sa83, or mutants thereof.

Embodiment 1-3. The method of embodiment 1-1, said composition comprising at least three bacteriophages selected from Sa87, J-Sa36, Sa83, or mutants thereof.

Embodiment 1-4. The method of embodiment 1-1, said composition comprising Sa87, J-Sa36, and Sa83, or mutants thereof.

Embodiment 1-5. The method of embodiment 1-1, said composition consisting essentially of Sa87, J-Sa36, and Sa83, or mutants thereof.

Embodiment 1-6. The method of any one of the preceding embodiments, wherein the mutant has at least 75% sequence identity across its entire genome when compared to Sa87, J-Sa36, or Sa83.

Embodiment 1-7. The method of any one of the preceding embodiments, wherein the mutant has at least 80% sequence identity across its entire genome when compared to Sa87, J-Sa36, or Sa83.

Embodiment 1-8. The method of any one of the preceding embodiments, wherein the mutant has at least 90% sequence identity across its entire genome when compared to Sa87, J-Sa36, or Sa83.

Embodiment 1-9. The method of any one of the preceding embodiments, wherein the mutant has at least 95% sequence identity across its entire genome when compared to Sa87, J-Sa36, or Sa83.

Embodiment 1-10. The bacteriophage composition according to any one of the preceding embodiments comprising one or more bacteriophages having a genomic sequence selected from: SEQ ID NO.: 1, SEQ ID NO.: 2, SEQ ID NO.: 3, and mutants thereof.

Embodiment 1-11. The bacteriophage composition according to embodiment 1-10 comprising at least two bacteriophages having a genomic sequence selected from: SEQ ID NO.: 1, SEQ ID NO.: 2, SEQ ID NO.: 3, and mutants thereof.

Embodiment 1-12. The bacteriophage composition according to embodiment 1-10 comprising three bacteriophages having a genomic sequence selected from: SEQ ID NO.: 1, SEQ ID NO.: 2, SEQ ID NO.: 3, and mutants thereof.

Embodiment 1-13. The bacteriophage composition according to any one of embodiments 1-10 to 1-12, consisting essentially of bacteriophages having a genomic sequence of: SEQ ID NO.: 1, SEQ ID NO.: 2, and SEQ ID NO.: 3, or mutants thereof.

Embodiment 1-14. The bacteriophage composition according to any one of embodiments 1-10 to 1-12, wherein the mutant has at least 75% sequence identity across its entire genome when compared to SEQ ID NO.: 1, SEQ ID NO.: 2, and/or SEQ ID NO.: 3.

Embodiment 1-15. The bacteriophage composition according to any one of embodiments 1-10 to 1-12, wherein the mutant has at least 80% sequence identity across its entire genome when compared to SEQ ID NO.: 1, SEQ ID NO.: 2, and/or SEQ ID NO.: 3.

Embodiment 1-16. The bacteriophage composition according to any one of embodiments 1-10 to 1-12, wherein the mutant has at least 90% sequence identity across its entire genome when compared to SEQ ID NO.: 1, SEQ ID NO.: 2, and/or SEQ ID NO.: 3.

Embodiment 1-17. The bacteriophage composition according to any one of embodiments 1-10 to 1-12, wherein the mutant has at least 95% sequence identity across its entire genome when compared to SEQ ID NO.: 1, SEQ ID NO.: 2, and/or SEQ ID NO.: 3.

Embodiment 1-18. The method of any one of the preceding embodiments, wherein the composition further comprises an antibiotic (e.g., a chemical antibiotic).

Embodiment 1-19. The method of embodiment 3-28, wherein the antibiotic is a fluoroquinolone, carbepenem, aminoglycoside, cephlasporin, penicillin, beta lactam, or beta lactamase inhibitor.

Embodiment 1-20. The method of any one of the preceding embodiments, wherein the composition further comprises a pharmaceutically acceptable carrier, diluent, excipient or combinations thereof.

Embodiment 1-21. The method according to embodiment 3-20, wherein the pharmaceutically acceptable carrier, diluent, excipient or combinations thereof comprises $MgSO_4$.

Embodiment 1-22. The method of any one of the preceding embodiments, wherein the bacterial infection comprises *Staphylococcus aureus*.

Embodiment 1-23. The method of any one of the preceding embodiments, further comprising administering an antibiotic (e.g., a chemical antibiotic) to the subject.

Embodiment 1-24. The method of embodiment 1-23, wherein the antibiotic is a fluoroquinolone, carbepenem, aminoglycoside, cephlasporin, penicillin, beta lactam, or beta lactamase inhibitor.

Embodiment 1-25. The method of any one of the preceding embodiments, wherein the bacterial infection is an infection characterized by the presence of a bacterial biofilm.

Embodiment 1-26. The method of any one of the preceding embodiments, wherein the bacterial infection is not a pulmonary infection.

Embodiment 1-27. The method of any one of the preceding embodiments, wherein the bacterial infection is rhinosinusitis, urinary tract infection, intra-abdominal infection, skin infection, skin structure infection, bacteremia, endocarditis, or an implant infection.

Embodiment 1-28. The method or embodiment 1-27, wherein the implant infection is a cardiac implant infection (e.g., ventricular assist device infection, pacemaker infection), prosthetic joint infection, or prosthetic valve endocarditis.

Embodiment 1-29. The method of any one of the preceding embodiments, wherein the bacterial infection is resistant to antibiotics.

Embodiment 1-30. The method of any one of the preceding embodiments, wherein the composition is administered via an aerosolized formulation of the composition.

Embodiment 1-31. The method of any one of embodiments 1-22 to 1-30, wherein the composition is administered intravenously.

Embodiment 1-32. A bacteriophage composition comprising one or more bacteriophages selected from Sa87, J-Sa36, Sa83, and mutants thereof, and a cryoprotectant.

Embodiment 1-33. A bacteriophage composition comprising one or more bacteriophages selected from bacteriophages having a genomic sequence selected from: SEQ ID NO.: 1, SEQ ID NO.: 2, SEQ ID NO.: 3, and mutants thereof, and a cryoprotectant.

Embodiment 1-34. The bacteriophage composition of embodiment 1-32 or 1-33, wherein the cryoprotectant comprises glycerol.

Embodiment 1-35. The composition or method of any one of the preceding embodiments, wherein the bacteriophage of the composition infect and lyse *Staphylococcus*.

Embodiment 1-36. The composition or method of any one of the preceding embodiments, wherein the bacteriophage of the composition infect and lyse *Staphylococcus aureus*.

Embodiment 1-37. The composition or method of any one of the preceding embodiments, wherein the bacteriophage of the composition infect and lyse methicillin-resistant *Staphylococcus aureus*.

SEQUENCE LISTING (10 sequences)

SEQ ID NO: 1 - DNA, 149108 bp, Artificial sequence
  Synthetic polynucleotide
  misc_feature: Genomic Nucleic Acid Sequence of Sa87
ggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatactctagaatatgcttacacacaagttaaaacaaatagaattagtcaataaaattaaatatgaagcggttgaatataaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttaattgcatcaatcacgcctaagcttgtaaattggtttttactactacaagataacataaatatttttttaagataagtgttgacaacctagaaacaacatgttaatattaatatataccaaatgagaggaattgattaattatgaaaatgacaaaagaaaattacagtagagtattagaagtttacaaagagaataaggacttgatagcacgccacaaggagcatttaaaagccaatgcaacgtataaagatttaaacgttaggttagcatttgatatcttttactcacaactattcccactagaacaaagacgtatcataagccaatcaggaacggataatgacctatgtgatagccacttgcaaaccgcatttttaaaagccttgaatgaaattggtttaaaagaataaaaaaactttcaaataagggcttgacttccaagccctagcatgttattattaagataacaaataaaacaaaaaggaaatgatacaaatgaaaaacgtacaaaacttgaaattttactcttacagtggatttgaaagtccggaattattagcaattggatttgataacttaattaaagatttaactgtagaaagcaattacctaggtgacgtgacaaatgacactatagatgaattgacggattggttagatatctttgatactattgaagaaatgcaagaacaccatgaaaatgtagtaaatggaatttggattaatccaacatatgaaaatttaaaagattttaatttatcggttggacttgatgaaaatacttatatagaaagttttaaataagtgttgacaacttaaacaatacatgttattattaagatacaaggtaagggaagcggtcaaccgcttccaacctagtaaaaaaagttttaaaaaaactattgacaagtcacttagccacatgatatacttagtataacaaatcaaacagaaaaggaattgattataatgaaatttatcaaaactattgaaaacttattggaaaaagctgaaaacaaaggggaagcaattttaaatggtcgtatgaatttaggttggggaatggttggaagcctagaagaaaaatatgcaatcgagattcaagataataaattggttatgcgtcattggggaacagaaacaattgaggttgacttgacaagaagtgagattgtttcatactatggagaaagcaattcagaccgtgatagcttaaatacgcttgtatattgcctaggaatggagccaaacttccgttacttaccaagcaaaaatttattcatctatgaaaattaattaaataaagggcttgacttccaagccctaccatgttattattaaggtagttaaaaaatacaaatcagaaaaggaattgatgaaaatgtttaaattagaaaataaagtggaaattatcgtacctaaggaagataacaacggtgttgagattgacaacttagtaatccgtgaatcattagaaaatattactaaaatatgtggaggttgtaccactacagacgttaaaggtcaatggtggtcagacaatgaacaacgtatcatgcaagacaataacactaactttgaatggtactataacaaggatatggaggacgtgaacgaccaacaagggctattaaaaggcttatctactattactagaattctaatcactgagtacggtcaagaaggcattagcattaaaattaatgatacactatatatcattgatgaaagtgatttaaatttcttatcatatgaattatacgctttaatgtttaagaattaaataaaaaaattatataaaccgcttcttatttaataatttgaagcggttattttcttttaaattagggcttgacaaatgtacgaaaaaatgagataatgaagtgatgactttttttcgtataaaaataatattatataaaaaaattatagataaaaataccctccacgtccattataccaattttgctcccacttgtcaatacttaaattaattaaaaaagtttataaaaagtattgacatttcttacaatccatagtataatatagatataaggttaaggagcccaagaccaaagaaggggtttcgggggaagtccgtccttttttatataaaaaataaccgtccacctctattatctcaaattttgcccctagtgtcaagaactttctttgaaataatttatttaaaaaagtttcataaatctattgacttactattaattatggtgtaatatatagatataaggttaaggaagcggaacacttaaaaaataaattaaaaaaacttttaaaaaggtgttgacaaacttcaaaccacatgttaatattaagataacaaataaaacaaaaaggaattgataattatgaacagattagaaatagtaaaagacacggcaatggaatacatcattatgatggataacggagttatggacggacaattaacacaagaggaatacaacgaagcggttagctttgaaaaggtttacgattacactttatcagaagcaaatcaagaatgtaaattcttaggcggtaaaattttaactttcctagtaaatgaagcaattgaagaatacgcataaaaaaacttaataaaaggggttgacattcaacccctaccatgttaatattaatatataccaaatgagaggaattgataattatgagatacgaaatcgtaacattagttaatggagagctacttatgtacgcaacattcaacaagcaggaagcagaagcaaaatatagtgaatggtgtgacctgtacggtcaagaaaatgtaagcatggaaaaaaattaaaataagcggttgacaaaataaccgcttcatgataatattaaactatactaaagaaaaggaaatgattacaatgacaaaaacaatcaaacaattagaaagccaattagagaaactagaaagaaaatcagatgaggaattagcaaatggatactatgaagcatttgaaagaacttgcgcacatattagagaattagacctacaaatcgaattaaaaaagaattcagaaactgtttaaaaaatctaaataaggggttgacacttaaccccttacatgttaatattaagatagttaaaaaatacaaataagaaaaggaattgatacaaatgaaattaatcaatagagataatgaaatcgtaattagtatagcaacacttgagagcgtaaaacaagccctaatttgggagtatatcgaccacttagataataacatcctagacaaagaaatacacgaccaggaagcggttgtagtgacttctcacactttacaacaaatcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacccaggtacttattttttgggaaaaattatgaaaataaatatttaaaagtcaacacctaaaatatagaaagtaagtcaacaccctatattaaaagtcaacattataacccctccctgtaagtcaataatttatagtacaaatagacaacctctaaatataaagtcaacatacctaaaataaaaaaagagggaaattaaatccctcctcttaggtattattaacaaactctaattcatgtatagtaatcatatccattccatagaaatctcttgggtctcctttaatgaactcttgctcacctctatggtttgtttcctctttataaccttcttctttaatacgtttaattaagttctccttatctgtatatatcttatcttctctaaaatggaagttatcttcataaggttcacaattatcatgttctacttggtatagtttcatattacttattctccttgattttttttagatagttttcataataagctcttgattcttgtgttaacttttctctttcttctctagaccattgtaatgctccccaaaatttctcataattttcttttgataagtcacctagtggactgcccttaggtaagtctttagtagcttctttttgtattttttctctttcttttttaatttcatctagtttttcttgattacctttaaatgtgactcttggtttggatagtaagaattctagtatttcttcatctgtaaatacctttgcataactatctttccatgtagtatcttcataagagtgtttacctgtatcttctaattcttttaacgccaattttgagtaaccttttgcatctataagccctctagtatacatacttgcagggtctaagaattttatttggttctcataattaataatacttgtttcgagtttaagtttggcttgttctttgttcatacttaatcctccttatacatttacactcatgattaagtaaaagtcatagaatttaccttcatattgttctacattgtatatatgagacattaatctataataatattctgcatcatgtgtacctttaaacgttttttcattaaactcatttttcattagattaactaacttgtctttagttagtacgaatacaccttcacaccattcttcaaactcatcataatatgtctctgcatctcttaaaagtaagtccataaaatatcctggttttctaaagtcatcttcaaagttaaatcctttataataattcttttctaatatatgtctatacctagcgttattaataaagtgctgtaagcctttctgttccacttttctattacttaatgtcacaccgattacttcaaagtctagtcccattatttttcctcctcttcataagaccacgtaccatattctgcattatagtgtgctgtatctgcaccttcatcttcatattctacactataccatgcatcctcctctgtttctgcatctatatatcttacctcttctgtagtaatagtacgttttactttgtatcttttcaactgtttttcctcctttatgttttcctctagtatttgttttaatgtctgacagtctttttggtctagagtatcccaactctctagattttgtaattgataaagtaactcatttacaatttcatcgaaggcttctgcttttttatatacttcttctagttctgtttctgctaattttctattccttttaatttgttctgctttagttactaagatatgggctttattcatttcctctataataaagtttttatagttttccattattatttatccctcctattttctatccgttgttttatctcttctctattgcggtggtgctccttactcatttctttacgttccttatttgttaaccttattctataaacaaggtagttaatgtataagataccggctgaccatagtagcaagaatgatattaaataagtccatgagatactaatttctatcattgtgattcctccttatctattgtaaaggatttacctgttctagagaatagtttaaacatttcttcttcaaaatattcatcactcatatctttatctttcaacatttcacagagtttgtcccatgcttctgctttattataaatggtttctacttctctatctgtttcatcactataattttcatatataatttgtaatacaaaatccttctcatcataacatttttcattaatatcatatttcattataattcctccttatattctttatagctcttgatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctaagaatacagaaagtataattaacattataggaagggctacaaaaaaacctagcccctgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacatagatatattcatttgagtcattttcataaataatatctatagctgtaatatctgaatatgctgtaatcatttcataagcgttcgtattatcagggtaagcaaaaccaacttgaggtatttccataggcttatcaataagaataccgaaataagtacagtgatgtgttcgacttatatttgaagtccctttatatgtaccatagtaatctataccttctgtaatacctgatatatggaacctgtttacgtctttaggttctaatcttacaacatcgcaattctctaatactaaatcaatatatttgatattcattttaactctcctttttatctttattataaatacaatgcacacggacatcttccattactttgcctaatagattctgacctttccagttactttgctctaatattttagggtcatttgctttaagacctactccccatattttatcataaggtgaagcttctacgaaatctttacgtacatctgtgtctaatattctttgctttaggtgtgtagtcataaatttatctttaactacttctaccataatatcatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttgatgtttaaactttatagggtagaagttagaataaatatcctctttaccccaaaacataatatattcacttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatggttactactctctacaaatgcgtttaagtcagcgtataactgaataaaaaaggacatgtcataattccaatacttaggctcatttctacctagttttttcttcattttcttgtattttttattcttttttagaccaaaaacttctttttcaaagtcatttaatttaagacctttaaaatattttttcttcatttcttaacctccaatttaataaatggaaaatcaatgtttctaaatactgcgcctacatcacacattaacatgtctccattaatttctacttctccactgtctgttggggtgtgaccacatacataggtaaaaccatcttttctaggttgaaagtctcttgaccatattaattggtcaattgtttgttcttctacaggcttccaactaaccccgcctgaatgagagaatatatacttgtcttctttatagtactttctacaattaaccataagtattttaaattttctatagtcgtctgattctttaagtttctttagttcacttttaataaaatcataattacttcttaggttttcttctacactactatactttaaagttaccgtactcacaccgtaagagttaagtgtttctatacaatatcttgagagccattcaatatcatagatacttaatcggtctacgttttccataatattataaaactcatcatcatggttgcctaatagtgttactacattatcatcattagacattaaatcaaatatataattaacaacgtcttttgaccttctacctctatctacataatctcctaagaatactattgtttcttcaggttttctttcattatttattttatccataattgttaataatttttggtattctccgtgaatatcgggaacaacgtatatagccatctaatctcctccttattgtatataactatcttaccatacttagtaaaaaaagtcaataaaaaaacacctattagtttaaataggtgtccgacagagctcccgtacttagattacggttaataatattttacgacaattatatgagaccctctgtcgttgaaacgctcgtcactgcgctattccacaagatattttagaaggtagcttgtggaagaagattgttttttattgtacttagtttatacactcttaaaagtacatgtgtgctatatatttatacaccaagcgtttggtgttagatacggaatggagggacactaccatccggagtctacggtcagatacaaagcctctgccgggcaacatacggtatctctcgtatatcaggttgactagacctttagagtttttcactccttctcttataaccattaacttaagagaaataggttttacttagtagatatgaaacaataaatccacatacaatattaaatcatagtcaagtgattgcacatatgtctaatacctataagttttttgctagcctggtatatgtatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcctactctcattataaggttaaaaaggctaactgtgtttagcattatataagaggctttagttaactactatactaataatataccataaattatacttaatgtcaagttaatttatcaattgaatctataatttttgatgtgctacgtatatccgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtacccattaactcttttaagttcaagataactattatatctaaagtaacgttgttcttctattaacttatcttttgttagataaggatactcatttataaatataggattacttgttccatagttatctctaatatattctgcgtcctctaaggaatcagtataacctaaaacttcataacttgttgtatacactgtatcttcttcccacaagtcatagtccatttcctctatttcttcttctaatatataaatttttttcatatattactcccaaaccccaataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcgggtattgtcctagcattcttgttccattttcattataaaaagtatattctactacaataatattcatcatatctacatatatagcttctatatacggtgtaatattttcttcttcttgtatgtgcttacctatgatatcatataataattctgagtgtattcttttatctctcattatagacctccgtaaggaatgctacagttttgtctttcaaagatttttctactaattccatagcatctttatagtgtttgatattagattcattagacttaagtttatcttttacttcttgaattagaggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagtcaattcttctttttttagtatgttattaatattaccgataacagaatatgctataggcttaaaattagctctaacataagttaaaaatataaaatcatcataaaataaatctaaaacagttttattaaatctagtatttttagcttgctctaattgagcacataaattaagaacattatcaaacccactttttagtactaaagagataaatctttctattgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccatcctgctaaagcatccatagctatatcatattcttcttcatttttaattcttataattttctctatttcttcctttgcttgtttagaactaataaaatcaatatcagtatcctctaggttagttaattctaaattttttctaataaaattcttttgacttggtgttatagaattaactcttacattttcgtgatttagaaattggtaaaagtccatattactcatcctttttaacgtattctgccatatcttttaaaatacttagtacgtattctaaatctctatattggtcatctaatgaccctataatagcatacggtgtcatatcccaggcatgtgcacagtcaaaccctaatactctcttaccctcatagtcataatcatcgtaagtaatacctctatgagcacgtctttctaaggagtcatattctttttcattgatatccgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgtttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctaccctcttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggatttaaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagtactcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttctcagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatctgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaattcaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaacgcaaagtgtctgtatacattccctacaaatgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtaccgtagagggtgtggatattgattatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacaaaatggcagttaccaatttgtttgtcaaaaatgtggtaaaccactagatagatggtataacggtgagtggcattgtaagtaccctgagcgtacaaaaggtaataaaggggtacgagggtatctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataacagggttacagtggataaattaatgcagaataaaagatacgtacaagcacttaagacaaaggatataagtgtttatagtacagtagatgatgatttaaaaactttcttaaaacattggcaaaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatattttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagagctatttctaatggtgaagaaggaaaggtaaaccctaaaaaagtagcaaattcattatctaatttaagtaaaaaaggtgtagatgtatcccatattaatacaaactcatcattgtataaagagtttgttgatgataacggtgatacaataggaattacatcttttaaacgaactgaaaatgatataatattagaatcttatgcaagttcacctgattcagatggtgtaggagcaagagctattatggaattattacgtttaagtattaaagaaaataaaaatgcagttgtgtatgacatagaattacctgaagcaatagagtatttaaaaactttaggatttaaacctaataaagatggatacattttaagaaaaaaagatgtaaaacaattcttaggtgattatagtgattttatttagcactatagtcatctattctattgtatttattttatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagtaaagaggagaaagaagatagtattaaagaatttagtagtttattatgtgaaatggtaaatagactatacaagtcttataatgtatttagacaagaccctatggatgaaactcaacgtctagatggctctttaatggtctttcaaagtagattaaatgaccctttaacaggagatttacatgataagatgtataaacttgctttttcaaaacgcattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaaccatctgaaccgtctgacaatcctgatgaaaatggaggatgggaaactgaaccaactgaacctgagtcaccttcagagccggacgataaagtggacgaagaggataaaaatgaagatactacagatgataaacagcccactgaacaaccggacgataacaacatagataatgaagataaaactgaagaggagtaattactcctctttttttgtttgctatattaaataagagctaaatataaaaaaattgaacattacggtggtgaaaactttgttaggaatgaatattataacgtcactatcagtagtatttacctgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttattataagttttataggtgcaatacttggaggaatttggtacaagatgatgaaaattattaaaaaaagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaagaagatgttttattacattgaagaaccgtttgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaaaaacgaacataacttacatgatattttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaggaaatgaaacgcatagaagattttattgttaatacaggtaaagataaagatgtagatagagattcatttcaaactttctgtaagaaaattgttagagatacttatatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagaattagctatgggtataagaaaccctagaactgaattatcttcttcaggatacggattatcagaagtagaaatagctatgaaagaatttattgcctacaataatacggaatcatttaatgatagatttttctcacatggtggtactactagaggtattttacagatacggtcagaccaacaacaatcacaacatgcattagagaactttaagcgtgaatggaaatctagtttatcaggtattaatggttcatggcaaattccagtggtaatggcagatgatattaaatttgtaaatatgacacctactgctaacgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgccagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcattaagtgaaactaatagaccgatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaagatgctcaatccggaaaactatctaaagaagagttagctaagaaagctaagaaaatggaaaaagaaggtaaaaaagaaggagaagataacgccactgattataaagaatctaaatcaggaaaaaatgaccaaaataaatcgaagactgatgataaagcagaagatacttatgatatggctcaaccactaagagatgctcatagtgctttagcaggtcttcctgcccctatatatttagctataggagctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataacagtcaatgttaatgttcaaggtggaaataatcctgaagaaactggagacattatcggaggaagaattagagaagttctagatagtaatatggatatctttgcaaatgaacataagagaagttattagtaattttgtattgacacaagagtagtatcataatatactactcttatacatataaaaaataaaaggaagtatgtgtatatgcgtagaataagaagacctaaggtaagaatagaaatcgttacagatgataatacatttacattgagatttgaagatacacgtgactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcgagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaatgccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacaaaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgatagtcatggtatatatttatacagtaatactaagggaattgttgttagtggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaatttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtaaaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattataggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattatagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaagaatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtataataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggcagaggtataactttagaacaaattattaataataatataggttatgttattaatgggagcttttataaagttgacggggaatccaaagtatcattaaggaatagtattatattttttacttatgataatgatggaaattaccagtattggaatacacgaagtatagaaaagaacccttatattaaatctattaatgctcctgctaaacaagatgaagtagggagaaaagatgtcatatttaatttgaatatagcaagaaagaaaaagttcttagttataactgagggtgtatttgatgctttaaccttccatgagtatggcgtagcaacattaggtaaacaagtaactgagaatcaaataaaaaaaataattgattatgttagtatagatacatcaatatatattatgttagacactgatgcattagataataatatagacttagcttataagttaaaaacacattttaataaagtttactttgtacctcatggtgatgaagatgcaaatgatatgggaacaaggaaagcttttgagttattaaaacagaaccgggtgctagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataacgagttaaacttaaatattttaattgatgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgaagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtaggtaaagctaaagataaactaaatgaaaaacgagaagcttacctaaaagagaaacaagaagaattacgtcaaaaacaacaagaagaagaacaaaaagaaactgaatctgacagcaatgaaaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataacgttcttttaaacaacagagagccacacacatggtgggagcaagtcattaatgatagtagtaaggtgaataagacaccttgcttaatatttactagaaatagagctcagagttatgttgctttaccttatgatgagaaagtatatgaagatttaagaaataatgaataccctgtcatgagaacagactttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagcaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaacgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgctagtgagtctgttagactagataaattatctattggtgttacaatccctaacaaatttatggagttagttaaagaaggtaaacctttctatacttttgatacttacgacattaataaagtgtacggtaagtatttagatgagctaaacattgatgaatggtatgataagttactagataatgatagtatcggtaaagtaaaacatgatgctagagaagttatgacagatattgctaaaacgcaattagaatcaggctacccttatgtattctatattgataatgctaatgataatcacccattgaaaaacctaggtaaagttaaaatgagtaacttatgtacagaaatttcacaattacaagaggtatcagaaatttatccgtactcttacagtaatcagaatgttattaatagagatgttgtctgtacattaggttctcttaacttggttaatgtggttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagggaagcattagacctagtaaacagtttatatagtgctattaacttccagtctattaagacatctatgttaatggctaaagaaacaggaaaaccatttaaaggctttgagaagtccgattatgctacaggtgaatactttgtaagatatattagagaatccaatcaacctaagacagataaagctaagaaagtcttaaataaggtttatattccaacacaagatgattgggatgaattagctaaagcagtaaaagtacatggcttgtataatggttatagaaaagcagaagcacctactcaatctatatcttatgtacagaatgctacaagttctattatgccagttcctagtgctatagagaatagacaatatggagatatggagacatattacccaatgccttacctaagtcctataactcagttcttctatgaaggagaaacagcttataagattgacaataaacgtattattaatacaagcgcagttgttcagaaacatacagaccaagcagtgtctacaatactttatgtagaatcagaaatccctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcttatagtcatatttttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaatttattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatacagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgttgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgttagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggagaaacaatactctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaatgggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggaaccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataagttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatctcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttgaggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgtagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtagatttgagcattccacttatcctcctgatgaggggtttgcgtatgtagattatgtagatgtgattcttattggtgtagataatcctaggaaaagaaagattattaccttaaaagtaaatgagttcaacccggatgactacagagtaggtcataagtacaatattataaaaatactatggtttgaaaaatgggaatggttaaagccataagtaaaaggagagaaataaaatgattatagataaattaaatggagttaaattagaaataggtgggcatgtcgtatcatttagtgtaagaaagtttaatacaattaatggtgagagacaattaatagactaccatcatattaaaagaaatagacaacagtactttagaactactgaagaattttataatgaatataaagaaattaagcctgacaaaaatgaaatagatgaaatgtttgaatctctaggttatgtagatactgagttagatgatgtagtaagaaaccaggaaaaggttactgaaatattaggagttagtgaacaatatttaaatcagttatcttataaagctatagaggagtatgtagataaagtagttacacttgaaattaaagagttgaaaggagagaaatagcatgaataataactgggaaaaagaaggagttaactattgggaaaaagaaggagttaactattgggaaaacgaagactgtcctagggaatacttagagaaagcattcattgacctggtagaatatgttgaaggagttacagtaccacctaaagatgttaagcagttaagagaagataaacttagagaagatattgggttttatgagtacgtagctgataaataaattagtatctacctattgacttaggtaggtatctattatataatagtatacaaggagatgaaaatatgaaaaagttaatagtattacttacaattactatttctctattactagggggttgctctcctgataaccatgaaggtaaagtagtaggagtaggtgaatacagagaaccaactacttatataaaatcaggtagcgttactgtaccagtcattggtgaaatgaaatactatgtagatttagagacagataaaggagaagaccgtgtatatcttaataaagaggtctatcataagtttgataaaggtgatgatttctctaatgtaggtgagaaagtgtataagaatgatgaattaatatataaaggagactaactatgtatttaaatgattatgtaggtaaatttataaaggaagataactattatggatatcaatctacagacttagtatctaattatgttcaacgattaactctaggtaggtacaaaactaagttaaatgctaataaaatgaaatacgaaagattacctagttcttggaaaataattaaagccaaagatttgttaagaacagatgattatagagaaggagatatatttgtatcagaaagaatctccgtattcggttttaatggtattattgtatataaccatgattttaacaatgtaactgttattactcaaaatagagatggtaaagctactaatcctgtagaggagcatttatatccaaagaaagatattgattatattattagacctatcgagagggactacagggaatactttaaaaaatcagattcaaaagaaaaagttactctttcgaagcaagaatataaaaaattattagaggcttataataaaatgaaggaagtgtttaagtaatatgaatagtacaaaattagtagagtactttacaaataaacaaggtaaatctctaatattacctgatgaaaataaagttgagttatatagagttgatgtaacaccttatactatgagacttaatttcacttacaatacagaagttgtagctatagatattgataagttacactcagattctatagaaatgcatataccacaaggtctttatataacaactgttgttaaaattactagtacgcagagtattagttcagttcttcataaggtattagaggaatgggtaagacaagtacaaaatgatggtatattcggattcgtatgggagtaattataatgataagtatagaacatgattatacaataagaactgtagataatagaaaatatacttattatagtaaatacgaatcactagttactttgtatgaaaatattatgagtaaagattgtattgaagtaactaaatatgggaaagataaaaaagttattattgatactagacatattgtatctattgaacgatggtaaataataaggaggagtaaactattatgataaatgcagggcatgctaagtacctatcagaaatttatgaagatgatgtacattatgaaactatagatagtattgtagaagatatactagataatattaatgatggtattattgaagaagctatgaaaggtaatacaagttatcaatatgttcttagagacttaagagtagataatgaagtagaatatagagttatagaagaacttactaaccaaggatatagtgtaaaccacattagtaatgatatagagtacccttctatatctacaaataatttagcagggttagattacttaaatattaaatggtaagggagggaattaatatgataaataaatataaaaagttatgggatgaaataactcaacaaattgttaatgtagaaattattaactttaaaaatgaaacagtaacaatagaatctacagatgattcaggattatcagagataagaggttttgaagaagtagagtttatagattactatggataagatgtttaaagtatataatttataaggaggaaacatatggacttgtttgcaaaaataattattatgtctataggagttgttcccttgttaactattattgttgcacagctaattacagattaccatgataatcattaagtattatagtaataggaaggacaatatttagagtgagagtatgttgactaatgaggaagatatagaatgagaacctaaccaagtaaaactaagtacctttgttatgtactactattactactactattactactactattactactactattactactactattactactactattactactactattactactactattactactactattactactactaagtacctttgttatgtactactattactactactattactactactaagtacctttgttatgtactactattactactactattactactaagtacctgggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatactctagaatatgcttacacacaagttaaaacaaatagaattagtcaataaaattaaatatgaagcggttgaatataaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttaattgcatcaatcacgcctaagcttgtaaattggtttttactactacaagataacataaatatttttttaagataagtgttgacaacctagaaacaacatgttaatattaatatataccaaatgagaggaattgattaattatgaaaatgacaaaagaaaattacagtagagtattagaagtttacaaagagaataaggacttgatagcacgccacaaggagcatttaaaagccaatgcaacgtataaagatttaaacgttaggttagcatttgatatcttttactcacaactattcccactagaacaaagacgtatcataagccaatcaggaacggataatgacctatgtgatagccacttgcaaaccgcatttttaaaagccttgaatgaaattggtttaaaagaataaaaaaactttcaaataagggcttgacttccaagccctagcatgttattattaagataacaaataaaacaaaaaggaaatgatacaaatgaaaaacgtacaaaacttgaaattttactcttacagtggatttgaaagtccggaattattagcaattggatttgataacttaattaaagatttaactgtagaaagcaattacctaggtgacgtgacaaatgacactatagatgaattgacggattggttagatatctttgatactattgaagaaatgcaagaacaccatgaaaatgtagtaaatggaatttggattaatccaacatatgaaaatttaaaagattttaatttatcggttggacttgatgaaaatacttatatagaaagttttaaataagtgttgacaacttaaacaatacatgttattattaagatacaaggtaagggaagcggtcaaccgcttccaacctagtaaaaaaagttttaaaaaaactattgacaagtcacttagccacatgatatacttagtataacaaatcaaacagaaaaggaattgattataatgaaatttatcaaaactattgaaaacttattggaaaaagctgaaaacaaaggggaagcaattttaaatggtcgtatgaatttaggttggggaatggttggaagcctagaagaaaaatatgcaatcgagattcaagataataaattggttatgcgtcattggggaacagaaacaattgaggttgacttgacaagaagtgagattgtttcatactatggagaaagcaattcagaccgtgatagcttaaatacgcttgtatattgcctaggaatggagccaaacttccgttacttaccaagcaaaaatttattcatctatgaaaattaattaaataaagggcttgacttccaagccctaccatgttattattaaggtagttaaaaaatacaaatcagaaaaggaattgatgaaaatgtttaaattagaaaataaagtggaaattatcgtacctaaggaagataacaacggtgttgagattgacaacttagtaatccgtgaatcattagaaaatattactaaaatatgtggaggttgtaccactacagacgttaaaggtcaatggtggtcagacaatgaacaacgtatcatgcaagacaataacactaactttgaatggtactataacaaggatatggaggacgtgaacgaccaacaagggctattaaaaggcttatctactattactagaattctaatcactgagtacggtcaagaaggcattagcattaaaattaatgatacactatatatcattgatgaaagtgatttaaatttcttatcatatgaattatacgctttaatgtttaagaattaaataaaaaaattatataaaccgcttcttatttaataatttgaagcggttattttcttttaaattagggcttgacaaatgtacgaaaaaatgagataatgaagtgatgactttttttcgtataaaaataatattatataaaaaaattatagataaaaataccctccacgtccattataccaattttgctcccacttgtcaatacttaaattaattaaaaaagtttataaaaagtattgacatttcttacaatccatagtataatatagatataaggttaaggagcccaagaccaaagaaggggtttcgggggaagtccgtccttttttatataaaaaataaccgtccacctctattatctcaaattttgcccctagtgtcaagaactttctttgaaataatttatttaaaaaagtttcataaatctattgacttactattaattatggtgtaatatatagatataaggttaaggaagcggaacacttaaaaaataaattaaaaaaacttttaaaaaggtgttgacaaacttcaaaccacatgttaatattaagataacaaataaaacaaaaaggaattgataattatgaacagattagaaatagtaaaagacacggcaatggaatacatcattatgatggataacggagttatggacggacaattaacacaagaggaatacaacgaagcggttagctttgaaaaggtttacgattacactttatcagaagcaaatcaagaatgtaaattcttaggcggtaaaattttaactttcctagtaaatgaagcaattgaagaatacgcataaaaaaacttaataaaaggggttgacattcaacccctaccatgttaatattaatatataccaaatgagaggaattgataattatgagatacgaaatcgtaacattagttaatggagagctacttatgtacgcaacattcaacaagcaggaagcagaagcaaaatatagtgaatggtgtgacctgtacggtcaagaaaatgtaagcatggaaaaaaattaaaataagcggttgacaaaataaccgcttcatgataatattaaactatactaaagaaaaggaaatgattacaatgacaaaaacaatcaaacaattagaaagccaattagagaaactagaaagaaaatcagatgaggaattagcaaatggatactatgaagcatttgaaagaacttgcgcacatattagagaattagacctacaaatcgaattaaaaaagaattcagaaactgtttaaaaaatctaaataaggggttgacacttaaccccttacatgttaatattaagatagttaaaaaatacaaataagaaaaggaattgatacaaatgaaattaatcaatagagataatgaaatcgtaattagtatagcaacacttgagagcgtaaaacaagccctaatttgggagtatatcgaccacttagataataacatcctagacaaagaaatacacgaccaggaagcggttgtagtgacttctcacactttacaacaaatcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacc

SEQ ID NO: 2 - DNA, 148312 bp, Artificial sequence
  Synthetic polynucleotide
  misc_feature: Genomic Nucleic Acid Sequence of J-Sa36
ggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctatgacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttttaactgatagttatgataataaagttttaaatactgtactcagatatattaatactactagtgatagagagcttagttacttaatgggtaaaggtgaagcggatgtatgtatagaaaagggagtatttagtaatatagaagatgttaaaattgactctgagtttattgatagaggtaacttatgtatacttataaatgaagatggattagtatgtagttactacagaggagaatcatgtaatgttggttcctttgtaaaggagaggttataatgatagaaattaggttaactgaagattataatgacttgagtcttaaggcattactaaaacgtattaaaagggtagctcctagggaattaacttatggtttagaagcggatatggatactacagatgttaatattggagattcagttccttctagaggtttatatgtagagtactcagaacgttttactagggacttatggataattgtacacccttcaggttatgatgcttattatcaaggagagaaatatggtggagagtctttagatgagattatacatgatatgttttatgattatgcagacccttttgacttagattattagaaaggagagattataatgatagagatataccttagtgaaaattatgataagaatttactaaaagcagaattaaaatggattaaagagaccgcttcaagagaactaacttatgatattaataggaaacctggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattatatacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcccagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaatttgagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgaatttcagggacttaggtatcggattatgggactatgacaacatcaataaactttacggatttaataaatatcgtgccaaatggtttggcggtggtgtagtattccaaagctataatatagaagatacattaaattttgcactagataatgttaaagaaatagaagcggttaagaattaaaaccgcttctgaattaaataaaaaatttatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataagttagtgtaaaattgactattgacaaggttgtattttttatggtataatgaagtgaagaccttttttagtataaaaaaattattatataaaaaatttatattaaatgattttagaaacgctctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaattcaaatggaaaaacaaaacaattaaatcaactcaaaaaacggataacattctattacttattataggtggtttagttgcaacaatcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacactacatgttattattaaggtacaaggtaagggaagcggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattaactaaagcagaaaacaaagggcaagcaattttaaacggtcgttattatgacggatatagaaacggtgagcttgaggaaaaatatgcaatcgaaattgatggcaacaaattaattatgcgtcattggggtacacaaacaattgagattgacttaagcataaatgaaattgtttcatactatggtgaaagcaattcagaccgtgacagtttaaacacacttgtatattgcttaggaattgcgccaaactttagatacttaccaagcaaagacttgttcatttacgaaaattaattaaataaagggcttgactttcaagccctaccatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcttaaccgcttctctaatacaattaatcaggagatgttgaagatgaatacaagacgggtaaacagagcgttaaacgaagcagttagattattagatgaacaaatagcagatactcaaaagactatgcaggagttgaataaacaactagagaagcaaataaaggctaagcaagagctaatggtattagttgatgttatgaatggtgatgatgagtaatgaacattagagaggttcacaatgtcgttaagagtgctaagagcaaactcctgcaggagcaggctcacccaacggataacctcatagagcagtacatcaatgatgagctacacagacgcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatgatataatgaacttaacaaattaaaagaaaaggaaatgatgaacatgacaaacttacaagaaagaaaacaagaattgaaaacgttactatttaacttagctttagagaagaacaaagcaactgatgagacactgcttagcgtattagagcaagcacatcaagaggtaggaaatcaattaagaaaagtaagaaaagaaatagaaattttagtagaagaaaaagaaagggaattttggaatgatatcgaatttaatggattagactaagagggaataaaatccctcttttatttttatcctattatataatttttttatattatacgggggcaggggtaaaatgccactcaatgggggtgggtctatatacccctatggtctacccaggtacttattttttggggaaaattatgaaaataaatatttaaaagtcaacacctaaaatatagaacgtaagtcaacaccctatattaaaagtcaacaatttatagtacaaatagagaacctctaaatataaagtcaacatatctaaaataagaaagagggaaattaaatccctcctcttaggtattattaacaacctctaattcatgtatagtaatcatatccatcccatagaaatctcttgggtctcctttaatgaactcttgctctcctctatggtttgtttcctctttataaccttcttctttaatacgtttaattaagttctccttatctgtatatatcttatcttctctaaaatggaagttatcttcataaggttcacaattatcatgttctacttggtatagtttcattagtcattttcctcctcttcgtaagaccatgtaccatattctgcattatagtgtgctgtatctgcgccttcatcttcatattctacactataccatgcatcctcctctgtttctgcatctatatatcttacctcttctgtagtaatagtacgttttactttgtatctcttcaactgtttttactcctttatattttcctctagtatttgttttaatgtctgacagtctttttggtctagagtatcccaactctctaaattttgtaattggtatagtaactcatttacaatttcatcgaaggcttctgcttttttatatacttcttctagttctgtttctgctaattttctattccttttaatttgttctgctttagctactaagatatgggctttattcatttcctctataataaagtttttatagttttccattattatttatccctcctattttctatccgttgttttatctcttctctattgcggtggtgctccttactcatttctttacgttccttatttgttaaccttatcctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctagaaatacataaaatataattaacattataggaagggctacaagaaaacctagaccttgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattctctaatactaaatcaatatatttgatattcattttaactctccttttatattaataattttttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtgaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgttttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccatatcatagttcttacttatagtccataatgtctctcctgctcttactttgtgataatatttatttccctctttgataaggtcattcaatattacctacccccttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgcgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagtcgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggattttaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagctctcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttcttagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatttgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaatttaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaatgcaaagtgtctgtatacattccctacaaacgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtactgtagagggtgtggatattgactatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacagaatggcagttaccaatttgtttgtcaaaaatgtggtaaaccactagatagatggtataatggtgagtggcattgtaagtaccctgagcgtacaaaaggtaataaaggggtacgaggatacctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataatagggttacagtggataaattaatgcagaataaaagatatgtacaagcacttaagacaaaggatataagtgtttatagtacagtagatgatgatttaaaaactttcttaaaacattggcagaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatactttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagggctatttctaatggtgaagaaggaaaggtaaaccctaaaaaggtagcaaattcattatctaatttaagtaaaaaaggtgtagatgtatcacatattaatacaaactcatcattgtataaagagtttgttgatgataacggtgatacattaggaattacatcttttaaacgaactgaaaatgatataatattagaatcttatgcaagttcacatgattcagatggtgtaggagcaagagctattatggaattattacgtttaagtattaaggaaaataaaaatgcagttgtgtatgatatagaattacctgaagcagtagagtatttaaaaactttaggatttaaacctaataaagatggatacatcttaagaaaaaaagatgtaaaacaattcttaggtgattatagtgattttatttagcactatagtcatctattctattgtatttattctatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagcaaagaggagaaagaagatagtattaaagaatttagcagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgtattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacctgaaccatctgaaccgtctgacaatcctgatgaaaatggaggatgggaaactgaaccaactgaacctgagtcaccttcagagccggacgataaagtggacgaagaagataaaaatgaagatactacagatgataaacagcccactgaacaaccggacgataacaacatagataatgaagataaaactgaagaggagtaattactcctcttttttgtttgctatattaaataagagctaaatataaaaaaattgaacattacggtggtgaaaactttgttaggaatgaatattataacgtcactatcagtagtatttacttgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttactataagttttataggtgcaatacttggaggaatttggtacaagatgatgaaaattattaaaaagagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaggtaatattagtagataaagataataatatactattagaagattatgatattgttatggaaagtaagaagatgttttattacattgaagaaccgttcgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaagaaatgaaacgtatagaagattttattgttaatacaggtaaagataaagatgtagatagagattcatttcaaactttctgtaagaaaattgttagagatacttacatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagagttagctataggtataagaaaccctagaactgaattatcttcttcaggatatggattatcagaagtagagatagctatgaaagagtttattgcctacaataacactgaatcatttaatgatagattcttctcccacggtggtactactagaggtattttacagatacgttcagaccaacaacaatcacaacatgcattagagaactttaagcgtgaatggaaatctagtttatcaggtatcaacggttcatggcaaataccagtggtaatggcagatgatattaaatttgtcaatatgacaccaactgctaatgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgctagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgtttgacatatgaccaaggtgcacgagttagaagtgaactaggtaaagtaagttcttatgagagccaaagaaaacaaaaccaacgtaatttggaacaagcaagagaacaatatagcaactatagaaaccaacaacaagacttgactaaacgtagagctagcggtcaaattaataaggcacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcactaagtgaaactaatagacctatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaggactctaaagaaggaaaactgtctaaagaagagttagctaagaaagctaagaaaatggaaaaagaaggtaaaaaagaaggagaagataacgccactgattataaagaatctaaatcaggaaaaaatgaccaaaataaatctaagactgatgataaagcagaagatacttatgatatggctcaaccactaagagatgctcatagtgctttagcaggtcttcctgcccctatatatttagctattggtgctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataaccgtcaatgttaatgttcaaggtggaaataatcctgaagaaactggagacattatcggaggaagaattagagaagttctagatagtaacatggatatctttgcaaatgaacataagagaagttattagtaattttgtattgacacaagagtagtatcatagtatactactcttatacatataaaaaataaaaggaagtatgtgtatatgcgtagaataagaagacctaaggtaagaatagaaatagttacagatgataatacatttacattgagatttgaagatacacgagactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcaagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaataccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacagaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgataatcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatctaatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataagtgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaagaggacaacgtactctagaagaaatgattgaattcattagaatcagagatgtatccttcgaagttaaaggactaaaccctaatgataataatttatatttattatttgatggagtaagatgtgctataacacctgcaactggctataggaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaagttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtacaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaagaatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccagggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtacaataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggtagaggtataactttagaacaaatcattaataacaatataggttatgttattaatgggagcttttataaagttgacggggaatccaaagtatcattaaggaatagtattatattttttacttatgataatgatggaaactaccagtactggaatacaagaagtatagagaagaacccttatattaaatctattaatgctcctgctaaacaagatgaagtagggagaaaagatgtcatatttaatttgaatatagcaagaaagaaaaagttcttagttataactgagggtgtatttgatgctttaaccttccatgagtatggagtagcaacattaggtaaacaagtaaccgagaatcaaataaaaaaaataattgattatgttagtatagatacatcaatatatattatgttagacactgatgcactagataataatatagacttagcttataagttaaaaacacattttaataaagtttactttgtacctcatggtgatgaagatgcaaatgatatggggacaaggaaagcctttgagttattaaaacagaaccgggtgttagtaacacctgaaagtatacagagttacaaaatacaacaaaaacttaaactttaggcttgaccttagagaagttttatgttatactagtaattaagtaattaataaaggagaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgggcagatgacagacttagaatataataatgagttaaacttaaatattttaattgacgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgcagtacaaggaactgttgatggtaaacaagttgatgagaaaacagctaaacaattagatagaattggttcacgtagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtagggaaagctaaagataaactaaatgaaaaacgagaagcttacctaaaagagaaacaagaagaattacgtcaaaaacaacaagaagaggcacagaaaaaaactgaatctgacagcaatgaaaaagtaattcagttgaagaaaaatgacgaacagtaagaaaaaaggggatacattcgaacgtaaaatagctaaagaattaacttcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataatgttcttctaaacaacagagagccacatacatggtgggagcaagtcattaatgatagtagcaaggtgaataagacaccttgcttaatatttactagaaatagagctcagagttatgttgctttaccttatgatgaaaaagtatatgaagatttaagaaataatgaataccctgtcatgagaacagattttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagtaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaacgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgccagtgagtctgttagactagataaattatctattggtgttacaatccctaacaaatttatggagttagttaaagaaggtaaacctttctatacttttgatacttacgacattaataaaatgtacggtaagtatttagatgagctaaacattgatgaatggtatgataagttactaaataatgatagtatcggtaaagtaaaacatgatgctagagaagttatgacagacattgctaaaacacaattagaatcagggtacccttatgtattctatattgataatgctaatgataatcacccattgaaaaacctaggtaaagttaaaatgagtaacttatgtacagaaatttcacaattacaagaggtatcagaaatttatccgtattcttacagtaatcagaatgttattaatagagatgttgtttgcacattaggttctcttaacttggttaatgtagttgaaaaaggtttattgaatgaatctgtagatattggtacaagagcattaacaaaagttactgatattacggatttaccttacttacctagtgttcaaaaagcaaatgatgatattagagctatcggtttaggttcaatgaatttacatggacttttagctaagaatatgattagttatggttctagagaagcattagacctagtaaacagtttatatagtgctattaacttccaatctattaagacatctatgttaatggctaaagaaacaggaaaaccatttaaaggctttgagaagtccgattacgctacaggtgaatactttgtaagatacattagagaatccaatcaacctaagacagataaagctaagaaagtcttagataaggtttatattccaacacaagatgattgggatgaattagctaaagcagtgaaagtacatggtttgtataatggttaccgaaaagcagaagcacctactcaatctatatcttatgtacagaatgctacaagttctattatgccagtacctagtgctatagagaatagacaatatggagatatggagacatattacccaatgccttacctaagtcctataactcagttcttctacgaaggagaaacagcttataagattgacaataaacgtattattaatacaagcgcagttgttcagaaacatacagaccaagcagtgtctacaatactttatgtagagtcagaaatacctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcgtatagtcatatctttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaattcattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatgcagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttcattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgagaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagcccttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgtaggaacagctaatgttactgtaactactgaagatggtagtcacactgatattgttgctgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtggaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgctagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggagtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttataggggaaacaatgctctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatagttagttttttaatactcattataatgcgtgtacttgaatattttgtaacaggtaatgctgtttactcacctttagcgcctgcagttattattatgtttgttttagcactaggtacatggaaagtaagtaagatgaacaaaatagtatcttatagaggaactattaagatgtactgggaactaagtaatgctgagcaaaaacaagctaaggtatttaagtatcctaatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctagagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggagccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgggattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataggttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaatggtattattgtattttacaaagaagaaaataaacatattctaaagaagctcttagaattcattaacacaacatcaaaaggattaacttacaccttagagggtacattagttgataatgatatcgttttacttaaagataacaacatatgtgattataacctaagacagtttagtaagacaaatgatggcttagttataggtctattgagtgaatcatataatgatgttcattactatgaaaaaggagatgcctacggtatagaaagattaactatgtatttagaggagatgagtcaataatggtaattgcattttttattttaggtctattattagtattatgtttagttggtcttgctattattaaagtactagaagcaaggctaaagaaaaaagaactaaggagagaaagagaatcttttggtattcctgaaccagggagaaaattagggcacataggatatgtcgaaagtaaatatgctttaattcataaagaatcaagtaagataataataagcgcagagaaaagtaaagttgtagaaacattacagaaaatgtataatttagagttaacatctgtagatgtttctagtgtaacgggactctctcccttaggtacaggacgtatggagaatatggtattgctttcatacaaactagaaagagaatgactttataaattaattgaacttaataaggagtgatacaatggaatttatagataaaaataatgtaattaaagcttatgatataccgaatgtttacttaaaaggttacgtattgtatgcatgtgataaaaatggagacattacaacctatgatgggtatgaccaaatacactataaagatggtagagtattaacattcccttttgataagccgttaagaaagataaatgtactttcaggatattacaaactatttaagaaggaggacatactatgatttattttgttagtgatttacattttggtcatgataatattagagaatttgaagcacctacaagaagtcattggaattcagtagaagaaatgactgaaggtttgattgaactatggaataacacaattacaaataatgatattgtttataatatcggagacttcttctttaatatgaaaccatctaaagtagaagaaatacttaatagactaaattacaaagagatgacattgattgcaggtaatcatgaccataaaaagcttgttaagctatatgaacgtaatggtatcacagtgaagtatgctgatatgcttaagaaggaaggtaaaagattttatctgagtcactaccctacacttattggaagaaagaatatgtttaatattcatggtcatatacattcacaactaatggatactgattaccacattaatgtaggttatgatgtagaaggaaagattgcatatagttttgatgatattctaagtatagcaggtgagtatagtggagaaattcaaaggtaaagacttatataagactagaattagaaaacaaacaattaaaaatttaattattaaagtagagaaattacataataaacatagcccttatcaacctattggtcatgtttattattaccctaaaacaaaagagtttactttatctaaacccgagcaaaagatatttatagagtatatgaaagaattaggttttaatgtaaaacacaagagacgtaagaaaacacttattatttataagaatgcattcactgaatacattagtaggtatcatgaagcaatagagcagattgaaggagggaaataatggaatatttatttttatttataggtattggcatgataatttggggtttcatagcaccttatcttgcatttgtagtttactataaacatgtaagagaaaatcataatggattcagtgatgaggaatctctagaagaggctatagtatttggtatgggattcatgtttatagcatttattcctataggtatactagttgtaattgaagaaattaagattttattcttttaaatgttgacagctacaatatagtgtgttacagtatagaaaaggaggttaattaatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttggggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtaggtttgaatattcatcttatttacctgatgaaggatttgcatatatagattatgtagatgtcattcttataggtgtagataatccaaagaagagaaaagttattactttaaaagcagatgagtttaatcctagtgattttaaggttggtcataaatataatattataaaaatactatggtttgagaaatgggaatggttacagccatagggaggagaggtatacaatgattatagataaattaaatggagttaaattagagattggcggtcatgttgtatcatttagtgtaagtaagtttaaaacgattaatggtgaaagacaattacttgattaccaccatatcaaaagaggtaaacagagatattttagaactactgaggaattctataatgagtacaaagaaataaaaccggataagaatgagatagatgaaatgtttgaatctttaggttacgtaaatactgaattagaagatgtagtaagaaaccaagagaaagtgacagagatattaggagttagtgaacagtatttaaaccaattgtcttataaggctatagaggaatatgtagaaaaaatagttatcttagaaattaaagaattaaaaggagagatacaatgataaacattaatgtaactgaaaaagaaaaattagttgtaggtgatttagtaaaatcaagagaagatggtacatggggtattgtagtagaagataagcaagacttaaatgtagttgtgttaaatgacgagccctggttattttataaatcaggaattaaaagagtagaagggcaattagaagaggactttaaatttattaaaaacagagaagagtatgatatagatgtagttaattcttcttataaataaattcacatctacctattgacttaggtagatacttattatataatagtatacaaggagatgaagtatgatgaatggaaaacaaatttatgtatttttaagtgaccaatacagtaaagatatactcagtttacaattaggtcttattaaggaatggtctaggagagaactaacttattcagatgatgtcggttcagatgcagatgttgttatttgtactgatatagtaagagatgatttcgtaaaaaaactaagtaaaaataatagcaatgcattatttgtatttattagttctagttattggataggttataaaggcggagaattctttgttgcagttcaagactatgtgaaaggtatgtaagatatgaaaaaattattaatattatttacattagctagcactttactattagcaggatgtacaccggataatcatgaaggaaaagttttaggaacaggagaatatagagagccaactacttatatcaagtcaggaagtgttactgtaccagttattggtgaaatgaaatactatgtagacttagaaacagataaaggtgaagaccgtgtttatcttaatagggaagtttatcgtaaatttgataaaggtgatgatttctctaatgtaggtaaaaaagtatataaaaatgatgaattaatatataaaggggactaattagtatgaaacaatttatacatgataaaaaagatagttataatagtacaaatcgtaattttgatattcaatattataaaggtatacctttacaacaaattgatagggggtatggtcaagcaagagctaggagatttacaataaataatacgaaccaaaatatatggatacctatgacatatttaaaacctaatggtactcttaaaaataacattgatatagattggatacttgttaaagaaaaatgtagtttaaagaaagcaggattagtaataaaaatagaaattacaggagatgtattataatgtatatattagaaagaacaattagaggttttgcaggtcaaacagaagatattttaccttaaaggagatgaattaataatggagtatgaaaaaatgattagagaaataatggtaaactctaaagaaatgtcactagaagataaaaaacatttaatgagtttattgatgagtgcttatggtgacttatcaatactagtagcttttgaagaagaaaacacagcacatatgtatgaagaaataaaacagtatgatactaaaaagttactgaaaccaagtatggtaagtaaagataattatatgaaataatatgtaaccaatcaggaggaataactaatgataaatatagaacatgattatacaataagaactgtagataatagaaagtatacttactatagtaaacatgaatccccagttactttatataaaaatattataagtaaagattgtattgaagtaactaaatatgggaaagataaaaaagttattatagctactaaatatattgtatctattgaacgatggtaattacaaggaggagtagttatgaatgctagggaagcacgtaaaaacactaaaaactataaggactctaatgtagtaactaaagagcaacacttaacttatatctataataagataaactacttgattgcaaatagtagtagtcagggtaagacatatgtggcaatgaatctaagaacagattatcctgatgagttttctttatctaaattaaaatatctaaaagaaattaaacagcactataaagacctaggatttaatgtgaaaacgcaagtaagaaaggcaaagtggtcagagaaaagtgtaatcaggtactactttaacttaggctatatagacagcgtgttagtacctattatacacattagttggtaattacaaggaggaatagttatgttttttaaaaagaagaagttaagcaatgtagagaaacaaataagacaaaaccgtaataaagaagacaaagaaagaaaagaacatcaagataagttaaatacagatatgtataaaacgtatgaattagataaaattgtagaagaacatttaagaaaattagacaatatatcccttgaaggattagaactaacttcagtgtgtttagggacaagacttgtttattattattcaataggcaaggattgggataaacaagtatatagtttaaacgaattagaatatatgaagaagaaatttaagaaactaggatttgaaactcagataacaaacgaagatataggatttcaaccttatatttatttaagattattatgggatgcataagtaattattattagaggaggaatagttggtgttgcacagttaattacggattatcatgacggacattaagtattgaatattgttgactaataataagaagaaaatattattactactaagtacctttgttatgtactactattactactactaagtacctttgttatgtactactattactactactaagtacctgggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctatgacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttttaactgatagttatgataataaagttttaaatactgtactcagatatattaatactactagtgatagagagcttagttacttaatgggtaaaggtgaagcggatgtatgtatagaaaagggagtatttagtaatatagaagatgttaaaattgactctgagtttattgatagaggtaacttatgtatacttataaatgaagatggattagtatgtagttactacagaggagaatcatgtaatgttggttcctttgtaaaggagaggttataatgatagaaattaggttaactgaagattataatgacttgagtcttaaggcattactaaaacgtattaaaagggtagctcctagggaattaacttatggtttagaagcggatatggatactacagatgttaatattggagattcagttccttctagaggtttatatgtagagtactcagaacgttttactagggacttatggataattgtacacccttcaggttatgatgcttattatcaaggagagaaatatggtggagagtctttagatgagattatacatgatatgttttatgattatgcagacccttttgacttagattattagaaaggagagattataatgatagagatataccttagtgaaaattatgataagaatttactaaaagcagaattaaaatggattaaagagaccgcttcaagagaactaacttatgatattaataggaaacctggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattatatacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcccagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaatttgagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgaatttcagggacttaggtatcggattatgggactatgacaacatcaataaactttacggatttaataaatatcgtgccaaatggtttggcggtggtgtagtattccaaagctataatatagaagatacattaaattttgcactagataatgttaaagaaatagaagcggttaagaattaaaaccgcttctgaattaaataaaaaatttatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataagttagtgtaaaattgactattgacaaggttgtattttttatggtataatgaagtgaagaccttttttagtataaaaaaattattatataaaaaatttatattaaatgattttagaaacgctctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaattcaaatggaaaaacaaaacaattaaatcaactcaaaaaacggataacattctattacttattataggtggtttagttgcaacaatcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacactacatgttattattaaggtacaaggtaagggaagcggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattaactaaagcagaaaacaaagggcaagcaattttaaacggtcgttattatgacggatatagaaacggtgagcttgaggaaaaatatgcaatcgaaattgatggcaacaaattaattatgcgtcattggggtacacaaacaattgagattgacttaagcataaatgaaattgtttcatactatggtgaaagcaattcagaccgtgacagtttaaacacacttgtatattgcttaggaattgcgccaaactttagatacttaccaagcaaagacttgttcatttacgaaaattaattaaataaagggcttgactttcaagccctaccatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcttaaccgcttctctaatacaattaatcaggagatgttgaagatgaatacaagacgggtaaacagagcgttaaacgaagcagttagattattagatgaacaaatagcagatactcaaaagactatgcaggagttgaataaacaactagagaagcaaataaaggctaagcaagagctaatggtattagttgatgttatgaatggtgatgatgagtaatgaacattagagaggttcacaatgtcgttaagagtgctaagagcaaactcctgcaggagcaggctcacccaacggataacctcatagagcagtacatcaatgatgagctacacagacgcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatgatataatgaacttaacaaattaaaagaaaaggaaatgatgaacatgacaaacttacaagaaagaaaacaagaattgaaaacgttactatttaacttagctttagagaagaacaaagcaactgatgagacactgcttagcgtattagagcaagcacatcaagaggtaggaaatcaattaagaaaagtaagaaaagaaatagaaattttagtagaagaaaaagaaagggaattttggaatgatatcgaatttaatggattagactaagagggaataaaatccctcttttatttttatcctattatataatttttttatattatacgggggcaggggtaaaatgccactcaatgggggtgggtctatatacccctatggtctacc

SEQ ID NO: 3 - DNA, 146004 bp, Artificial sequence
  Synthetic polynucleotide
  misc_feature: Genomic Nucleic Acid Sequence of Sa83
ggaattcttttacctctctcactcagcctattacttattaccgacttccataactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccatacacgcacatatacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatacattaaattttgcactagataatgttaaagaaatagaagcggttaagaattaaaaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttagttgcaacagtcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacaatagatgttaatattaagatacaaggtaagggaagtggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattagaaaaagcagaaaacaaagggcaagcaattttaaatggtcgttactttgacggatatagtaaaggtgaacttgaagaaaaatatgcaattgaaattgatggcaacaaattagttatgcgtcattggggtacacaaacaattgagattgacttaagcataaatgagattgtttcatattacggtgaaagcaactcagaccgtgacagtttaaacacacttgtatattgcttaggaattgaaccaaactttagatacttaccaagcaaagacttgttcatttacgaaaattaattaaataaagggcttgactttcaagccctacaatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacccaggtacttattttttgggaaaaattatgaaaataaatatttaaaagtcaacacctaaaatatagaaagtaagtcaacaccctatattaaaagtcaacattataacccctccctgtaagtcaataatttatagtacaaatagacaacctctaaatataaagtcaacatacctaaaataaaaaaagagggaaattaaatccctcctcttaggtattattaacaaactctaattcatgtatagtaatcatatccattccatagaaatctcttgggtctcctttaatgaactcttgctcacctctatggtttgtttcctctttataaccttcttctttaatacgtttaattaagttctccttatctgtatatatcttatcttctctaaaatggaagttatcttcataaggttcacaattatcatgttctacttggtatagtttcatattacttattctccttgattttttttagatagttttcataataagctcttgattcttgtgttaacttttctctttcttctctagaccattgtaatgctccccaaaatttctcataattttcttttgataagtcacctagtggactgcccttaggtaagtctttagtagcttctttttgtattttttctctttcttttttaatttcatctagtttttcttgattacctttaaatgtgactcttggtttggatagtaagaattctagtatttcttcatctgtaaatacctttgcataactatctttccatgtagtatcttcataagagtgtttacctgtatcttctaattcttttaacgccaattttgagtaaccttttgcatctataagccctctagtatacatacttgcagggtctaagaattttatttggttctcataattaataatacttgtttcgagtttaagtttggcttgttctttgttcatacttaatcctccttatacatttacactcatgattaagtaaaagtcatagaatttaccttcatattgttctacattgtatatatgagacattaatctataataatattctgcatcatgtgtacctttaaacgttttttcattaaactcatttttcattagattaactaacttgtctttagttagtacgaatacaccttcacaccattcttcaaactcatcataatatgtctctgcatctcttaaaagtaagtccataaaatatcctggttttctaaagtcatcttcaaagttaaatcctttataataattcttttctaatatatgtctatacctagcgttattaataaagtgctgtaagcctttctgttccacttttctattacttaatgtcacaccgattacttcaaagtctagtcccattatttttcctcctcttcataagaccacgtaccatattctgcattatagtgtgctgtatctgcaccttcatcttcatattctacactataccatgcatcctcctctgtttctgcatctatatatcttacctcttctgtagtaatagtacgttttactttgtatcttttcaactgtttttcctcctttatgttttcctctagtatttgttttaatgtctgacagtctttttggtctagagtatcccaactctctagattttgtaattgataaagtaactcatttacaatttcatcgaaggcttctgcttttttatatacttcttctagttctgtttctgctaattttctattccttttaatttgttctgctttagttactaagatatgggctttattcatttcctctataataaagtttttatagttttccattattatttatccctcctattttctatccgttgttttatctcttctctattgcggtggtgctccttactcatttctttacgttccttatttgttaaccttattctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctaggaatacagaaaatataattaacattatagggagggctacaagaaaacctagcccctgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattttctaatactaaatcaatatatttgatattcattttaactctccttttatattaataattctttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtaaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgtttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctaccctcttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggatttaaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagtactcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttctcagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaataggctagtgcatctttaaactctaacttaaggatatccttatatttaatcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttatggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatctgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaataagaaaaagttagaagaagaggatacaagaaaatatatagctgatgggtttatgaatggtatcggtaaattaatgtacgaatttaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaacgcaaagtgtctgtatacattccctacaaatgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtaccgtagagggtgtggatattgattatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacaaaatggcagttaccaatttgtttgtcaaaaatgtggtaaaccactagatagatggtataacggtgagtggcattgtaagtaccctgagcgtacaaaaggtaataaaggggtacgagggtatctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataacagggttacagtggataaattaatgcagaataaaagatacgtacaagcacttaagacaaaggatataagtgtttatagtacagtagatgatgatttaaaaactttcttaaaacattggcaaaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatattttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagagctatttctaatggtgaagaaggaaaggtaaaccctaaaaaagtagcaaattcattatctaatttaagtaaaaaaggtgtagatgtatcccatattaatacaaactcatcattgtataaagagtttgttgatgataacggtgatacaataggaattacatcttttaaacgaactgaaaatgatataatattagaatcttatgcaagttcacctgattcagatggtgtaggagcaagagctattatggaattattacgtttaagtattaaagaaaataaaaatgcagttgtgtatgacatagaattacctgaagcaatagagtatttaaaaactttaggatttaaacctaataaagatggatacattttaagaaaaaaagatgtaaaacaattcttaggtgattatagtgattttatttagcactatagtcatctattctattgtatttattctatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagcaaagaggagaaagaagatagtattaaagaatttagcagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgcattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacctgaacctgaaccatctgaaccgtctgacaatcctgatgaaaatggaggatgggaaacggaaccaactgaacctgagtcaccttcagagccggacgataaagtggacgaagaggataaaaatgaagatactacagatgataaacagcccactgaacaaccggacgataacaacatagataatgaagataaaactgaagaggagtaattactcctctttttttgtttgctatattaaataagagctaaatataaaaaaattgaacattacggtggtgaaaactttgttaggaatgaatattataacgtcactatcagtagtatttacctgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttattataagttttataggtgcaatacttggaggaatttggtacaagatgatgaaaattattaaaaaaagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaagaagatgttttattacattgaagaaccgtttgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaaaaacgaacataacttacatgatattttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaggaaatgaaacgcatagaagattttattgttaatacaggtaaagataaagatgtagatagagattcatttcaaactttctgtaagaaaattgttagagatacttatatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagaattagctatgggtataagaaaccctagaactgaattatcttcttcaggatacggattatcagaagtagaaatagctatgaaagaatttattgcctacaataatacggaatcatttaatgatagatttttctcacatggtggtactactagaggtattttacagatacggtcagaccaacaacaatcacaacatgcattagagaactttaagcgtgaatggaaatctagtttatcaggtattaatggttcatggcaaattccagtggtaatggcagatgatattaaatttgtaaatatgacacctactgctaacgatatgcaatttgagaaatggttaaattaccttatcaatattatatctgctttatatggtattgaccctgcagaaattggtttccctaatagaggaggagctacaggttctaaaggtggttctactttaaatgaggctgacccaggtaaaaaacaacaacaatctcaaaataaaggtttacaacctttacttagatttattgaagacttagttaatagacatattatatcagaatatggagataagtatacattccaattcgtaggtggagatactaagagtgctacggataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgccagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcattaagtgaaactaatagaccgatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaagatgctcaatccggaaaactatctaaagaagagttagctaagaaagctaagaaaatggaaaaagaaggtaaaaaagaaggagaagataacgccactgattataaagaatctaaatcaggaaaaaatgaccaaaataaatcgaagactgatgataaagcagaagatacttatgatatggctcaaccactaagagatgctcatagtgctttagcaggtcttcctgcccctatatatttagctataggagctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataacagtcaatgttaatgttcaaggtggaaataatcctgaagaaactggagacattatcggaggaagaattagagaagttctagatagtaatatggatatctttgcaaatgaacataagagaagttattagtaattttgtattgacacaagagtagtatcataatatactactcttatacatataaaaaataaaaggaagtatgtgtatatgcgtagaataagaagacctaaggtaagaatagaaatcgttacagatgataatacatttacattgagatttgaagatacacgtgactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcgagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaatgccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacaaaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgatagtcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaaattattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtaaaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaataatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtataataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggcagaggtataactttagaacaaattattaataataatataggttatgttattaatgggagcttttataaagttgatggggaatccaaagtatcattaaggaatagtattatattttttacttatgataatgatggaaattaccagtattggaatacacgaagtatagaaaagaacccgtatattaaatctatcaatgcccctgctaaacaagatgaagtagggagaaaagatgtcatatttaatttgaatatagcaagaaagaaaaagttcttagttataactgagggtgtatttgatgctttaaccttccatgagtatggcgtagcaacattaggtaaacaagtaactgagaatcaaataaaaaaaataattgattatgttagtatagatacatcaatatatattatgttagacactgatgcattagataataatatagacttagcttataagttaaaaacacattttaataaagtttactttgtacctcatggtgatgaagatgcaaatgatatgggaacaaggaaagcttttgagttattaaaacagaaccgggtgctagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataacgagttaaacttaaatattttaattgatgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgaagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtaggtaaagctaaagataaactaaatgaaaaacgagaagcttacctaaaagagaaacaagaagaattacgtcaaaaacaacaagaagaggcacagaaaaaaactgaatctgacagcaatgaaaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataacgttcttttaaacaacagagagccacacacatggtgggagcaagtcattaatgatagtagtaaggtgaataagacaccttgcttaatatttactagaaatagagctcagagttatgttgctttaccttatgatgagaaagtatatgaagatttaagaaataatgaataccctgtcatgagaacagactttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagcaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaacgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggcggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttatctaaatatattccataatgatatcctggatttattaagttctaagaaaatcaatgctagtgagtctgttagactcgataaattatctattggtgttacaatccctaacaaatttatggagttagttaaagaaggtaaacctttctatacttttgatacttacgacattaataaagtgtacggtaagtatttagatgagctaaacattgatgaatggtatgataagttactaaataatgatagtatcggtaaagtaaaacatgatgctagagaagttatgacagatattgctaaaacgcaattagaatcaggctacccttatgtattctatattgataatgctaatgataatcacccattgaaaaacctaggtaaagttaaaatgagtaacttatgtacagaaatttcacaattacaagaggtatcagaaatttatccgtactcttacagtaatcagaatgttattaatagagatgttgtctgtacattaggttctcttaacttggttaatgtggttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagggaagcattagacctagtaaacagtttatatagtgctattaacttccagtctattaagacatctatgttaatggctaaagaaacaggaaaaccatttaaaggctttgagaagtccgattatgctacaggtgaatactttgtaagatatattagagaatccaatcaacctaagacagataaagctaagaaagtcttaaataaggtttatattccaacacaagatgattgggatgaattagctaaagcagtaaaagtacatggcttgtataatggttatagaaaagcagaagcacctactcaatctatatcttatgtacagaatgctacaagttctattatgccagttcctagtgctatagagaatagacaatatggagatatggagacatattacccaatgccttacctaagtcctataactcagttcttctatgaaggagaaacagcttataagattgacaataaacgtattattaatacaagcgcagttgttcagaaacatacagaccaagcagtgtctacaatactttatgtagaatcagaaatccctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcttatagtcatatttttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaatttattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatacagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgttgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgttagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggggaaacaatactctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggcggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggagccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataagttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatctcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttgaggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtagatttgagcattccacttatcctcctgatgaggggtttgcgtatgtagattatgtagatgtgattcttattggtgtagataatcctaggaaaagaaagattattaccttaaaagtaaatgagttcaacccggatgactacagagtaggtcataagtacaatattataaaaatactatggtttgaaaaatgggaatggttaaagccataagtaaaaggagagaaataaaatgattatagataaattaaatggagttaaattagaaataggtgggcatgtcgtatcatttagtgtaagaaagtttaatacaattaatggtgagagacaattaatagactaccatcatattaaaagaaatagacaacagtactttagaactactgaagaattttataatgaatataaagaaattaagcctgacaaaaatgaaatagatgaaatgtttgaatctctaggttatgtagatactgagttagatgatgtagtaagaaaccaggaaaaggttactgaaatattaggagttagtgaacaatatttaaatcagttatcttataaagctatagaggagtatgtagataaagtagttacacttgaaattaaagagttgaaaggagagaaatagcatgaataataactgggaaaaagaaggagttaactattgggaaaaagaaggagttaactattgggaaaacgaagactgtcctagggaatacttagagaaagcattcattgacctggtagaatatgttgaaggagttacagtaccacctaaagatgttaagcagttaagagaagataaacttagagaagatattgggttttatgagtacgtagctgataaataaattagtatctacctattgacttaggtaggtatctattatataatagtatacaaggagatgaaaatatgaaaaagttaatagtattacttacaattactatttctctattactagggggttgctctcctgataaccatgaaggtaaagtagtaggagtaggtgaatacagagaaccaactacttatataaaatcaggtagcgttactgtaccagtcattggtgaaatgaaatactatgtagatttagagacagataaaggagaagaccgtgtatatcttaataaagaggtctatcataagtttgataaaggtgatgatttctctaatgtaggtgagaaagtgtataagaatgatgaattaatatataaaggagactaactatgtatttaaatgattatgtaggtaaatttataaaggaagataactattatggatatcaatctacagacttagtatctaattatgttcaacgattaactctaggtaggtacaaaactaagttaaatgctaataaaatgaaatacgaaagattacctagttcttggaaaataattaaagccaaagatttgttaagaacagatgattatagagaaggagatatatttgtatcagaaagaatctccgtattcggttttaatggtattattgtatataaccatgattttaacaatgtaactgttattactcaaaatagagatggtaaagctactaatcctgtagaggagcatttatatccaaagaaagatattgattatattattagacctatcgagagggactacagggaatactttaaaaaatcagattcaaaagaaaaagttactctttcgaagcaagaatataaaaaattattagaggcttataataaaatgaaggaagtgtttaagtaatatgaatagtacaaaattagtagagtactttacaaataaacaaggtaaatctctaatattacctgatgaaaataaagttgagttatatagagttgatgtaacaccttatactatgagacttaatttcacttacaatacagaagttgtagctatagatattgataagttacactcagattctatagaaatgcatataccacaaggtctttatataacaactgttgttaaaattactagtacgcagagtattagttcagttcttcataaggtattagaggaatgggtaagacaagtacaaaatgatggtatattcggattcgtatgggagtaattataatgataagtatagaacatgattatacaataagaactgtagataatagaaaatatacttattatagtaaatacgaatcactagttactttgtatgaaaatattatgagtaaagattgtattgaagtaactaaatatgggaaagataaaaaagttattattgatactagacatattgtatctattgaacgatggtaaataataaggaggagtaaactattatgataaatgcagggcatgctaagtacctatcagaaatttatgaagatgatgtacattatgaaactatagatagtattgtagaagatatactagataatattaatgatggtattattgaagaagctatgaaaggtaatacaagttatcaatatgttcttagagacttaagagtagataatgaagtagaatatagagttatagaagaacttactaaccaaggatatagtgtaaaccacattagtaatgatatagagtacccttctatatctacaaataatttagcagggttagattacttaaatattaaatggtaagggagggaattaatatgataaataaatataaaaagttatgggatgaaataactcaacaaattgttaatgtagaaattattaactttaaaaatgaaacagtaacaatagaatctacagatgattcaggattatcagagataagaggttttgaagaagtagagtttatagattactatggataagatgtttaaagtatataatttataaggaggaaacatatggacttgtttgcaaaaataattattatgtctataggagttgttcccttgttaactattattgttgcacagctaattacagattaccatgataatcattaagtattatagtaataggaaggacaatatttagagtgagagtatgttgactaatgaggaagatatagaatgagaacctaaccaagtaaaactaagtacctttgttatgtactactattactactactattactactactattactactactattactactactattactactactattactactactattactactactaagtacctttgttatgtactactattactactactaagtacctttgttatgtactactattactactactattactactactattactattactactactattactactactaagtacctgggaattcttttacctctctcactcagcctattacttattaccgacttccataactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccatacacgcacatatacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatacattaaattttgcactagataatgttaaagaaatagaagcggttaagaattaaaaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttagttgcaacagtcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacaatagatgttaatattaagatacaaggtaagggaagtggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattagaaaaagcagaaaacaaagggcaagcaattttaaatggtcgttactttgacggatatagtaaaggtgaacttgaagaaaaatatgcaattgaaattgatggcaacaaattagttatgcgtcattggggtacacaaacaattgagattgacttaagcataaatgagattgtttcatattacggtgaaagcaactcagaccgtgacagtttaaacacacttgtatattgcttaggaattgaaccaaactttagatacttaccaagcaaagacttgttcatttacgaaaattaattaaataaagggcttgactttcaagccctacaatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacc

SEQ ID NO: 4 - DNA, 140698 bp, Artificial sequence
  Synthetic polynucleotide
ggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccatacacgcacatatacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatactctagaatatgcttacacacaagttaaaacaaatagaattagtcaataaaattaaatatgaagcggttgaatataaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttagttgcaacagtcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacaatagatgttaatattaagatacaaggtaagggaagcggtcaaccgcttccaacctaaataaaaaaagtttaaaaaaactattgacagtcacttgaaaccatgatattattaagataacaaaaaacaaacagaaaaggaattgattataatgaaatttatcaaaactatcgaaaacttattaactaaagcagaaaacaaagggcaagcaattttaaatggtcgttactttgacggatatagtaaaggtgaacttgaagaaaaatatgcaatcgaaattgatggcaacaaattaattatgcgtcattggggtacacaaacaattgagattgacttaagcataaatgagattgtttcatactatggtgaaagcaattcagaccgtgacagtttaaacacacttgtatattgcttaggaattgaaccaaactttagatacttaccaagcaaagacttgttcatttacgaaaattaattaaataaagggcttgactttcaagccctacaatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacccaggtacttattttttgggaaaaattatgaaaataaatatttaaaagtcaacacctaaaatatagaaagtaagtcaacaccctatattaaaagtcaacattataacccctccctgtaagtcaataatttatagtacaaatagacaacctctaaatataaagtcaacatacctaaaataaaaaaagagggaaattaaatccctcctcttaggtattattaacaaactctaattcatgtatagtaatcatatccattccatagaaatctcttgggtctcctttaatgaactcttgctcacctctatggtttgtttcctctttataaccttcttctttaatacgtttaattaagttctccttatctgtatatatcttatcttctctaaaatggaagttatcttcataaggttcacaattatcatgttctacttggtatagtttcatattacttattctccttgattttttttagatagttttcataataagctcttgattcttgtgttaacttttctctttcttctctagaccattgtaatgctccccaaaatttctcataattttcttttgataagtcacctagtggactgcccttaggtaagtctttagtagcttctttttgtattttttctctttcttttttaatttcatctagtttttcttgattacctttaaatgtgactcttggtttggatagtaagaattctagtatttcttcatctgtaaatacctttgcataactatctttccatgtagtatcttcataagagtgtttacctgtatcttctaattcttttaacgccaattttgagtaaccttttgcatctataagccctctagtatacatacttgcagggtctaagaattttatttggttctcataattaataatacttgtttcgagtttaagtttggcttgttctttgttcatacttaatcctccttatacatttacactcatgattaagtaaaagtcatagaatttaccttcatattgttctacattgtatatatgagacattaatctataataatattctgcatcatgtgtacctttaaacgttttttcattaaactcatttttcattagattaactaacttgtctttagttagtacgaatacaccttcacaccattcttcaaactcatcataatatgtctctgcatctcttaaaagtaagtccataaaatatcctggttttctaaagtcatcttcaaagttaaatcctttataataattcttttctaatatatgtctatacctagcgttattaataaagtgctgtaagcctttctgttccacttttctattacttaatgtcacaccgattacttcaaagtctagtcccattatttttcctcctcttcataagaccacgtaccatattctgcattatagtgtgctgtatctgcaccttcatcttcatattctacactataccatgcatcctcctctgtttctgcatctatatatcttacctcttctgtagtaatagtacgttttactttgtatcttttcaactgtttttcctcctttatgttttcctctagtatttgttttaatgtctgacagtctttttggtctagagtatcccaactctctagattttgtaattgataaagtaactcatttacaatttcatcgaaggcttctgcttttttatatacttcttctagttctgtttctgctaattttctattccttttaatttgttctgctttagttactaagatatgggctttattcatttcctctataataaagtttttatagttttccattattatttatccctcctattttctatccgttgttttatctcttctctattgcggtggtgctccttactcatttctttacgttccttatttgttaaccttattctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctaggaatacagaaaatataattaacattatagggagggctacaagaaaacctagcccctgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattttctaatactaaatcaatatatttgatattcattttaactctccttttatattaataattctttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtaaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgtttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacagctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctaccctcttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggattttaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcctttagtatcagtacttacaggcaaaaaagtacgtatttagaaaataaggagctctcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttctcagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtacatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatctgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaattcaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccgtaaattttgttgcggtctctaaactctgttaaacgggcatagtaaaataatgtatagaaaaataatatactggtaagaaaccctaaatctgactatacacagacagtgggaaccaaccgtgctaaatctgtaatttaattattgacaaaataacaatatatgatataattatattatagtaaaagcctaacgactaaatttctagttatctatataaatggatatagtgagaactagataagaaaattaactatacttaaaaaaactaaaatattttaaaagagaggtgaaaacagttgacattagaaaagagaaaacaagaatatcttaagaagttaaagcaaattaaaaatgatgagtttgaattgctaggaggatttactaaaacaagagagaaagctttatttaaacataaagtttgtggttatgaatggtatactactccttataatttattgaagtctaaagggacaggatgtcctaaatgtcaatacagagataaatcatatactactgatgaatttaaaaagaaacttaaagataaatttggttatgaatatgagttaatagaaggacaagagtataaaaatagtagagaaaaattattgtttattcataataagtgcggtactgaatttaaaattacaagtgatagtttatttcgaagtaaagtaccttgtcataaatgttctaaagaaaatagaaaaactaaaaagaaaacaacagaacagtttaaaaatgaattgtataataaacataaagatgaatatatacttgttgaagggtcagaatataagacagctcttgaaaaggttagaataattcatacgaaatgtggatatacatgggatgttagagcctcacatattttgcatactagtaaatgtcctaattgtaatgagtctaaaggtgagagtttaattaaagacattcttgaagataataatttttcttatataagagagtatacttttgaagatttaaagaatgttaaaaaattaccttttgattttgcactattcattgataatgaattagtaggtttaattgaatatgatggttctcaacactttattccttttgaacactttggaggtaaggaaaaattaagaaaaactcaatataacgatagaaagaaaaatgagtattgtgataagaacagaattccgttaaagagaataaagtatgatttagatgaaaaagaagtaataagagaaatagaaatgtttttaaatagtatagttaaaagtaaagcagagagttattaaccaaaaatagtaactatgatatagtctaatccctaagtaaatattgagaaatcaagggtataaatgggcaagttaaaatagtaaatgatactcatcctaataaggctgtaataaaatcacgtcagttaggtcttagtgaaatgggtgtaatggaaatggttcattttgcagatatgcatagttatgctaacgcaaagtgtctgtatacattccctacaaatgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtaccgtagagggtgtggatattgattatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacaaaatggcagttaccaatttgtttgtcaaaaatgtggtaaaccactagatagatggtataacggtgagtggcattgtaagtaccctgagcgtacaaaaggtaataaaggggtacgagggtatctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataacagggttacagtggataaattaatgcagaataaaagatacgtacaagcacttaagacaaaggatataagtgtttatagtacagtagatgatgatttaaaaactttcttaaaacattggcaaaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatattttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagagctatttctaatggtgaagaaggaaaggtaaaccctaaaaaagtagcaaattcattatctaatttaagtaaaaaaggtgtagatgtatcccatattaatacaaactcatcattgtataaagagtttgttgatgataacggtgatacaataggaattacatcttttaaacgaactgaaaatgatataatattagaatcttatgcaagttcacctgattcagatggtgtaggagcaagagctattatggaattattacgtttaagtattaaagaaaataaaaatgcagttgtgtatgacatagaattacctgaagcaatagagtatttaaaaactttaggatttaaacctaataaagatggatacattttaagaaaaaaagatgtaaaacaattcttaggtgattatagtgattttatttagcactatagtcatctattctattgtatttattttatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagcaaagaggagaaagaagatagtattaaagaatttagcagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgcattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaaccatctgaaccgtctgacaatcctgatgaaaatggaggatgggaaacggaaccaactgaacctgagtcaccttcagagccggacgataaagtggacgaagaggataaaaatgaagatactacagatgataaacagcccactgaacaaccggacgataacaacatagataatgaagataaaactgaagaggagtaattactcctctttttttgtttgctatattaaataagagctaaatataaaaaaattgaacattacggtggtgaaaactttgttaggaatgaatattataacgtcactatcagtagtatttacctgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttattataagttttataggtgcaatacttggaggaatttggtacaagatgatgaaaattattaaaaaaagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaagaagatgttttattacattgaagaaccgtttgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaggaaatgaaacgcatagaagattttattgttaatacaggtaaagataaagatgtagatagagattcatttcaaactttctgtaagaaaattgttagagatacttatatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagaattagctatgggtataagaaaccctagaactgaattatcttcttcaggatacggattatcagaagtagaaatagctatgaaagaatttattgcctacaataatacggaatcatttaatgatagatttttctcacatggtggtactactagaggtattttacagatacggtcagaccaacaacaatcacaacatgcattagagaactttaagcgtgaatggaaatctagtttatcaggtattaatggttcatggcaaattccagtggtaatggcagatgatattaaatttgtaaatatgacacctactgctaacgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattaaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgccagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcattaagtgaaactaatagaccgatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaagatgctcaatccggaaaactatctaaagaagagttagctaagaaagctaagaaaatggaaaaagaaggtaaaaaagaaggagaagataacgccactgattataaagaatctaaatcaggaaaaaatgaccaaaataaatcgaagactgatgataaagcagaagatacttatgatatggctcaaccactaagagatgctcatagtgctttagcaggtcttcctgcccctatatatttagctataggagctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataacagtcaatgttaatgttcaaggtggaaataatcctgaagaaactggagacattatcggaggaagaattagagaagttctagatagtaatatggatatctttgcaaatgaacataagagaagttattagtaattttgtattgacacaagagtagtatcataatatactactcttatacatataaaaaataaaaggaagtatgtgtatatgcgtagaataagaagacctaaggtaagaatagaaatcgttacagatgataatacatttacattgagatttgaagatacacgtgactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcgagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaatgccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacaaaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgatagtcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaatttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatgggaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtaaaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattatagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaagaatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtacaataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggcagaggtataactttagaacaaattattaataataatataggttatgttattaatgggagcttttataaagttgatggggaatccaaagtatcattaaggaatagtattatattttttacttatgataatgatggaaattaccagtattggaatacacgaagtatagaaaagaacccgtatattaaatctatcaatgcccctgctaaacaagatgaagtaggtagaaaagatgtcatatttaatttgaatatagcaagaaagaaaaagttcttagttataactgagggtgtatttgatgctttaaccttccatgagtatggcgtagcaacattaggtaaacaagtaactgagaatcaaataaaaaaaataattgattatgttagtatagatacatcaatatatattatgttagacactgatgcattagataataatatagacttagcttataagttaaaaacacattttaataaagtttactttgtacctcatggtgatgaagatgcaaatgatatgggaacaaggaaagcttttgagttattaaaacagaaccgggtgctagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataacgagttaaacttaaatattttaattgatgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgaagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtaggtaaagctaaagataaactaaatgaaaaacgagaagcttacctaaaagagaaacaagaagaattacgtcaaaaacaacaagaagaggcacagaaaaaaactgaatctgacagcaatgaaaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataacgttcttttaaacaacagagagccacacacatggtgggagcaagtcattaatgatagtagtaaggtgaataagacaccttgcttaatatttactagaaatagagctcagagttatgttgctttaccttatgatgagaaagtatatgaagatttaagaaataatgaataccctgtcatgagaacagactttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagcaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggcacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaaggttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgctagtgagtctgttagactagataaattatctattggtgttacaatccctaacaaatttatggagttagttaaagaaggtaaacctttctatacttttgatacttacgacattaataaagtgtacggtaagtatttagatgagctaaacattgatgaatggtatgataagttactaaataatgatagtatcggtaaagtaaaacatgatgctagagaagttatgacagacattgctaaaacacaattagaatcaggctacccttatgtattctatattgataatgctaatgataatcacccattgaaaaacctaggtaaagttaaaatgagtaacttatgtacagaaatttcacaattacaagaggtatcagaaatttatccgtactcttacagtaatcagaatgttattaatagagatgttgtctgtacattaggttctcttaacttggttaatgtggttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagggaagcattagacctagtaaacagtttatatagtgctattaacttccagtctattaagacatctatgttaatggctaaagaaacaggaaaaccatttaaaggctttgagaagtccgattacgctacaggtgaatactttgtaagatacattagagaatccaatcaacctaagacagataaagctaagaaagtcttagataaggtttatattccaacacaagatgattgggatgaattagctaaagcagtgaaagtacatggtttgtataatggttatagaaaagcagaagcacctactcaatctatatcttatgtacagaatgctacaagttctattatgccagttcctagtgctatagagaatagacaatatggagatatggagacatattacccaatgccttacctaagtcctataactcagttcttctatgaaggagaaacagcttataagattgacaataaacgtattattaatacaagcgcagttgttcagaaacatacagaccaagcagtgtctacaatactttatgtagaatcagaaatccctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcttatagtcatatttttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaatttattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcgggactataaaacagacaagaaagctattggttatgcgttagataatttagaattaaaagatgatgttaaagagcttcttgaattacttaaatatcatgctagtatacagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggttgccttaaatagccacagtgacttgtaaagagttattacaaaaccatgtgaattgctgggaagccttaaagacttattaactacaacgtaactggaaacagtaggcgtgaatgtttaaaaataataagtatatgagttatatggtataacgaaaaatctttgttatattatatagtgtaggtaatcagcatccaagcttctaagttgaaaaataagaagaaggttcaacgactatcgaaaagatatctagtaccgagaggtattagagagtaactgagtagagtaaaagatattaatctttgaagtgcatgggaattgcctacgaaatctattagaaaaatggagagtagtataatatggtaaaacgagtttggactaatgaagagaaacaagatatagtaaaatcatttcaagaaggtaaaacgtttaaagaattacaagataagtataatgcacattatttcactatcaagaaaattttagatgagtttaatattgacacaaataaaaaacgaagatggactaataagcaaaaacaagatatactaagaatgtatactaaagagtctatgactatagcagagataaaaaaggtatatacaacacacgcaagagaaataggtagaatactaaaagactttggagtagatacttcttactatcaaactagaagcgttaatagaaatataaatagaaatttctttgaagtaattgatactgaagagaaagcttatatactaggtttattaatggctgatgggtgtgttagatatagacgagaagggcaatgttacttaacactagaattgattgataaagaaatagtaaaaagagttcaaaaagaattgaattcagacagtaaaatatatgaatcacatagaaaaagagattatataaaaaacgaaaaacaaacttatacttttagtgttaccgatgaaaaactatgtaatgacttagctaaatatggtatagtacctatgaagtctaaaaaaacagaatgtttaacacaagatataccttatgatttaagaaaacattacttaagaggattgtttgacggtgatggttctatcgggtattataataatagatggtttataactttaattaataatcatcctgaatttttaaaagatgtaggtacttggattgatgatttattaggtttaaaatgtcctaaagtatctaaaactagtacctcttatagaataggttatacaggtaaaaaagctaaagaattaatgaaattactatatcaagataataatattcatataatccgaaaacaaaaacttgcagaccaggcaattcaagatatagtctaagcccactattaaattagtgttaaagtactaggaaactaggggtagtaactgaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgttgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgttagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggggaaacaatactctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggagccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattgttgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataggttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatctcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttgaggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtagatttgagcattccacttatcctcctgatgaggggtttgcgtatgtagattatgtagatgtgattcttattggtgtagataatcctaggaaaagaaagattattaccttaaaagtaaatgagttcaacccggatgactacagagtaggtcataagtacaatattataaaaatactatggtttgaaaaatgggaatggttaaagccataagtaaaaggagagaaataaaatgattatagataaattaaatggagttaaattagaaataggtgggcatgtcgtatcatttagtgtaagaaagtttaatacaattaatggtgagagacaattaatagactaccatcatattaaaagaaatagacaacagtactttagaactactgaagaattttataatgaatataaagaaattaagcctgacaaaaatgaaatagatgaaatgtttgaatctctaggttatgtagatactgagttagatgatgtagtaagaaaccaggaaaaggttactgaaatattaggagttagtgaacaatatttaaatcagttatcttataaagctatagaggagtatgtagataaagtagttacacttgaaattaaagagttgaaaggagagaaatagcatgaataataactgggaaaaagaaggagttaactattgggaaaaagaaggagttaactattgggaaaacgaagactgtcctagggaatacttagagaaagcattcattgacctggtagaatatgttgaaggagttacagtaccacctaaagatgttaagcagttaagagaagataaacttagagaagatattgggttttatgagtacgtagctgataaataaattagtatctacctattgacttaggtaggtatctattatataatagtatacaaggagatgaaaatatgaaaaagttaatagtattacttacaattactatttctctattactagggggttgctctcctgataaccatgaaggtaaagtagtaggagtaggtgaatacagagaaccaactacttatataaaatcaggtagcgttactgtaccagtcattggtgaaatgaaatactatgtagatttagagacagataaaggagaagaccgtgtatatcttaataaagaggtctatcataagtttgataaaggtgatgatttctctaatgtaggtgagaaagtgtataagaatgatgaattaatatataaaggagactaactatgtatttaaatgattatgtaggtaaatttataaaggaagataactattatggatatcaatctacagacttagtatctaattatgttcaacgattaactctaggtaggtacaaaactaagttaaatgctaataaaatgaaatacgaaagattacctagttcttggaaaataattaaagccaaagatttgttaagaacagatgattatagagaaggagatatatttgtatcagaaagaatctccgtattcggttttaatggtattattgtatataaccatgattttaacaatgtaactgttattactcaaaatagagatggtaaagctactaatcctgtagaggagcatttatatccaaagaaagatattgattatattattagacctatcgagagggactacagggaatactttaaaaaatcagattcaaaagaaaaagttactctttcgaagcaagaatataaaaaattattagaggcttataataaaatgaaggaagtgtttaagtaatatgaatagtacaaaattagtagagtactttacaaataaacaaggtaaatctctaatattacctgatgaaaataaagttgagttatatagagttgatgtaacaccttatactatgagacttaatttcacttacaatacagaagttgtagctatagatattgataagttacactcagattctatagaaatgcatataccacaaggtctttatataacaactgttgttaaaattactagtacgcagagtattagttcagttcttcataaggtattagaggaatgggtaagacaagtacaaaatgatggtatattcggattcgtatgggagtaattataatgataagtatagaacatgattatacaataagaactgtagataatagaaaatatacttattatagtaaatacgaatcactagttactttgtatgaaaatattatgagtaaagattgtattgaagtaactaaatatgggaaagataaaaaagttattattgatactagacatattgtatctattgaacgatggtaaataataaggaggagtaaactattatgataaatgcagggcatgctaagtacctatcagaaatttatgaagatgatgtacattatgaaactatagatagtattgtagaagatatactagataatattaatgatggtattattgaagaagctatgaaaggtaatacaagttatcaatatgttcttagagacttaagagtagataatgaagtagaatatagagttatagaagaacttactaaccaaggatatagtgtaaaccacattagtaatgatatagagtacccttctatatctacaaataatttagcagggttagattacttaaatattaaatggtaagggagggaattaatatgataaataaatataaaaagttatgggatgaaataactcaacaaattgttaatgtagaaattattaactttaaaaatgaaacagtaacaatagaatctacagatgattcaggattatcagagataagaggttttgaagaagtagagtttatagattactatggataagatgtttaaagtatataatttataaggaggaaacatatggacttgtttgcaaaaataattattatgtctataggagttgttcccttgttaactattattgttgcacagctaattacagattaccatgataatcattaagtattatagtaataggaaggacaatatttagagtgagagtatgttgactaatgaggaagatatagaatgagaacctaaccaagtaaaactaagtacctttgttatgtactactattactactactattactactactattactactactaagtactactactattactactactaagtacctttgttatgtactactaagtacctttgttatgtactactattactactactactactactattactactactattactactactattactactactattactactactattactactactattactattactactactattactattactactactattactactactattactactactaagtacctg

SEQ ID NO: 5 - DNA, 137904 bp, Artificial sequence
  Synthetic polynucleotide
ggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccatacacgcacatatacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatactctagaatatgcttacacacaagttaaaacaaatagaattagtcaataaaattaaatatgaagcggttgaatataaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttagttgcaacagtcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacaatagatgttaatattaagatacaaggtaagggaagcggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattaactaaagcagaaaacaaagggcaagcaattttaaatggtcgttactttgacggatatagtaaaggtgaacttgaagaaaaatatgcaattgaaattgatggcaacaaattaattatgcgtcattggggtacacaaacaattgagattgacttaagcataaatgagattgtttcatactatggtgaaagcaattcagaccgtgacagtttaaacacacttgtatattgcttaggaattgaaccaaactttagatacttaccaagcaaagacttgttcatttacgaaaattaattaaataaagggcttgactttcaagccctacaatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacccaggtacttattttttgggaaaaattatgaaaataaatatttaaaagtcaacacctaaaatatagaaagtaagtcaacaccctatattaaaagtcaacattataacccctccctgtaagtcaataatttatagtacaaatagacaacctctaaatataaagtcaacatacctaaaataaaaaaagagggaaattaaatccctcctcttaggtattattaacaaactctaattcatgtatagtaatcatatccattccatagaaatctcttgggtctcctttaatgaactcttgctcacctctatggtttgtttcctctttataaccttcttctttaatacgtttaattaagttctccttatctgtatatatcttatcttctctaaaatggaagttatcttcataaggttcacaattatcatgttctacttggtatagtttcatattacttattctccttgattttttttagatagttttcataataagctcttgattcttgtgttaacttttctctttcttctctagaccattgtaatgctccccaaaatttctcataattttcttttgataagtcacctagtggactgcccttaggtaagtctttagtagcttctttttgtattttttctctttcttttttaatttcatctagtttttcttgattacctttaaatgtgactcttggtttggatagtaagaattctagtatttcttcatctgtaaatacctttgcataactatctttccatgtagtatcttcataagagtgtttacctgtatcttctaattcttttaacgccaattttgagtaaccttttgcatctataagccctctagtatacatacttgcagggtctaagaattttatttggttctcataattaataatacttgtttcgagtttaagtttggcttgttctttgttcatacttaatcctccttatacatttacactcatgattaagtaaaagtcatagaatttaccttcatattgttctacattgtatatatgagacattaatctataataatattctgcatcatgtgtacctttaaacgttttttcattaaactcatttttcattagattaactaacttgtctttagttagtacgaatacaccttcacaccattcttcaaactcatcataatatgtctctgcatctcttaaaagtaagtccataaaatatcctggttttctaaagtcatcttcaaagttaaatcctttataataattcttttctaatatatgtctatacctagcgttattaataaagtgctgtaagcctttctgttccacttttctattacttaatgtcacaccgattacttcaaagtctagtcccattatttttcctcctcttcataagaccacgtaccatattctgcattatagtgtgctgtatctgcaccttcatcttcatattctacactataccatgcatcctcctctgtttctgcatctatatatcttacctcttctgtagtaatagtacgttttactttgtatcttttcaactgtttttcctcctttatgttttcctctagtatttgttttaatgtctgacagtctttttggtctagagtatcccaactctctagattttgtaattgataaagtaactcatttacaatttcatcgaaggcttctgcttttttatatacttcttctagttctgtttctgctaattttctattccttttaatttgttctgctttagttactaagatatgggctttattcatttcctctataataaagtttttatagttttccattattatttatccctcctattttctatccgttgttttatctcttctctattgcggtggtgctccttactcatttctttacgttccttatttgttaaccttattctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctaggaatacagaaaatataattaacattatagggagggctacaagaaaacctagcccctgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattttctaatactaaatcaatatatttgatattcattttaactctccttttatattaataattctttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtaaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgtttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctaccctcttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggatttaaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtgaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttctcagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatctgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaattcaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaacgcaaagtgtctgtatacattccctacaaatgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtaccgtagagggtgtggatattgattatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacaaaatggcagttaccaatttgtttgtcaaaaatgtggtaaaccactagatagatggtataacggtgagtggcattgtaagtaccctgagcgtacaaaaggtaataaaggggtacgagggtatctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataacagggttacagtggataaattaatgcagaataaaagatacgtacaagcacttaagacaaaggatataagtgtttatagtacagtagatgatgatttaaaaactttcttaaaacattggcaaaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatattttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagagctatttctaatggtgaagaaggaaaggtaaaccctaaaaaagtagcaaattcattatctaatttaagtaaaaaaggtgtagatgtatcccatattaatacaaactcatcattgtataaagagtttgttgatgataacggtgatacaataggaattacatcttttaaacgaactgaaaatgatataatattagaatcttatgcaagttcacctgattcagatggtgtaggagcaagagctattatggaattattacgtttaagtattaaagaaaataaaaatgcagttgtgtatgacatagaattacctgaagcaatagagtatttaaaaactttaggatttaaacctaataaagatggatacattttaagaaaaaaagatgtaaaacaattcttaggtgattatagtgattttatttagcactatagtcatctattctattgtatttattttatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagtaaagaggagaaagaagatagtattaaagaatttagtagtttattatgtgaaatggtaaatagactatacaagtcttataatgtatttagacaagaccctatggatgaaactcaacgtctagatggctctttaatggtctttcaaagtagattaaatgaccctttaacaggagatttacatgataagatgtataaacttgctttttcaaaacgcattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaaccatctgaaccgtctgacaatcctgatgaaaatggaggatgggaaactgaaccaactgaacctgagtcaccttcagagccggacgataaagtggacgaagaggataaaaatgaagatactacagatgataaacagcccactgaacaaccggacgataacaacatagataatgaagataaaactgaagaggagtaattactcctctttttttgtttgctatattaaataagagctaaatataaaaaaattgaacattacggtggtgaaaactttgttaggaatgaatattataacgtcactatcagtagtatttacctgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttattataagttttataggtgcaatacttggaggaatttggtacaagatgatgaaaattattaaaaaaagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaagaagatgttttattacattgaagaaccgtttgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaggaaatgaaacgcatagaagattttattgttaatacaggtaaagataaagatgtagatagagattcatttcaaactttctgtaagaaaattgttagagatacttatatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagaattagctatgggtataagaaaccctagaactgaattatcttcttcaggatacggattatcagaagtagaaatagctatgaaagaatttattgcctacaataatacggaatcatttaatgatagatttttctcacatggtggtactactagaggtattttacagatacggtcagaccaacaacaatcacaacatgcattagagaactttaagcgtgaatggaaatctagtttatcaggtattaatggttcatggcaaattccagtggtaatggcagatgatattaaatttgtaaatatgacacctactgctaacgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattaaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgccagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcattaagtgaaactaatagaccgatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaagatgctcaatccggaaaactatctaaagaagagttagctaagaaagctaagaaaatggaaaaagaaggtaaaaaagaaggagaagataacgccactgattataaagaatctaaatcaggaaaaaatgaccaaaataaatcgaagactgatgataaagcagaagatacttatgatatggctcaaccactaagagatgctcatagtgctttagcaggtcttcctgcccctatatatttagctataggagctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataacagtcaatgttaatgttcaaggtggaaataatcctgaagaaactggagacattatcggaggaagaattagagaagttctagatagtaatatggatatctttgcaaatgaacataagagaagttattagtaattttgtattgacacaagagtagtatcataatatactactcttatacatataaaaaataaaaggaagtatgtgtatatgcgtagaataagaagacctaaggtaagaatagaaatcgttacagatgataatacatttacattgagatttgaagatacacgtgactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcgagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaatgccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacaaaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgatagtcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaatttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtaaaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattataggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattatagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaagaatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtataataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggcagaggtataactttagaacaaattattaataataatataggttatgttattaatgggagcttttataaagttgatggggaatccaaagtatcattaaggaatagtattatattttttacttatgataatgatggaaattaccagtattggaatacacgaagtatagaaaagaacccgtatattaaatctatcaatgcccctgctaaacaagatgaagtaggtagaaaagatgtcatatttaatttgaatatagcaagaaagaaaaagttcttagttataactgagggtgtatttgatgctttaaccttccatgagtatggcgtagcaacattaggtaaacaagtaactgagaatcaaataaaaaaaataattgattatgttagtatagatacatcaatatatattatgttagacactgatgcattagataataatatagacttagcttataagttaaaaacacattttaataaagtttactttgtacctcatggtgatgaagatgcaaatgatatgggaacaaggaaagcttttgagttattaaaacagaaccgggtgctagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataacgagttaaacttaaatattttaattgatgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgaagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtaggtaaagctaaagataaactaaatgaaaaacgagaagcttacctaaaagagaaacaagaagaattacgtcaaaaacaacaagaagaagaacaaaaagaaactgaatctgacagcaatgaaaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataacgttcttttaaacaacagagagccacacacatggtgggagcaagtcattaatgatagtagtaaggtgaataagacaccttgcttaatatttactagaaatagagctcagagttatgttgctttaccttatgatgagaaagtatatgaagatttaagaaataatgaataccctgtcatgagaacagactttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagcaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaacgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttatctaaatatattccataatgatatcctggatttattaagttctaagaaaatcaatgctagtgagtctgttagactcgataaattatctattggtgttacaatccctaacaaatttatggagttagttaaagaaggtaaacctttctatacttttgatacttacgacattaataaagtgtacggtaagtatttagatgagctaaacattgatgaatggtatgataagttactaaataatgatagtatcggtaaagtaaaacatgatgctagagaagttatgacagatattgctaaaacacaattagaatcagggtacccttatgtattctatattgataatgctaatgataatcacccattgaaaaacctaggtaaagttaaaatgagtaacttatgtacagaaatttcacaattacaagaggtatcagaaatttatccgtactcttacagtaatcagaatgttattaatagagatgttgtctgtacattaggttctcttaacttggttaatgtggttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagggaagcattagacctagtaaacagtttatatagtgctattaacttccagtctattaagacatctatgttaatggctaaagaaacaggaaaaccatttaaaggctttgagaagtccgattatgctacaggtgaatactttgtaagatacattagagaatccaatcaacctaagacagataaagctaagaaagtcttaaataaggtttatattccaacacaagatgattgggatgaattagctaaagcagtaaaagtacatggcttgtataatggttatagaaaagcagaagcacctactcaatctatatcttatgtacagaatgctacaagttctattatgccagttcctagtgctatagagaatagacaatatggagatatggagacatattacccaatgccttacctaagtcctataactcagttcttctatgaaggagaaacagcttataagattgacaataaacgtattattaatacaagcgcagttgttcagaaacatacagaccaagcagtgtctacaatactttatgtagaatcagaaatccctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcttatagtcatatttttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaatttattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatgcagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgttgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgttagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggggaaacaatactctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaatgggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggaaccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataggttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatctcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttgaggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtagatttgagcattccacttatcctcctgatgaggggtttgcgtatgtagattatgtagatgtgattcttattggtgtagataatcctaggaaaagaaagattattaccttaaaagtaaatgagttcaacccggatgactacagagtaggtcataagtacaatattataaaaatactatggtttgaaaaatgggaatggttaaagccataagtaaaaggagagaaataaaatgattatagataaattaaatggagttaaattagaaataggtgggcatgtcgtatcatttagtgtaagaaagtttaatacaattaatggtgagagacaattaatagactaccatcatattaaaagaaatagacaacagtactttagaactactgaagaattttataatgaatataaagaaattaagcctgacaaaaatgaaatagatgaaatgtttgaatctctaggttatgtagatactgagttagatgatgtagtaagaaaccaggaaaaggttactgaaatattaggagttagtgaacaatatttaaatcagttatcttataaagctatagaggagtatgtagataaagtagttacacttgaaattaaagagttgaaaggagagaaatagcatgaataataactgggaaaaagaaggagttaactattgggaaaaagaaggagttaactattgggaaaacgaagactgtcctagggaatacttagagaaagcattcattgacctggtagaatatgttgaaggagttacagtaccacctaaagatgttaagcagttaagagaagataaacttagagaagatattgggttttatgagtacgtagctgataaataaattagtatctacctattgacttaggtaggtatctattatataatagtatacaaggagatgaaaatatgaaaaagttaatagtattacttacaattactatttctctattactagggggttgctctcctgataaccatgaaggtaaagtagtaggagtaggtgaatacagagaaccaactacttatataaaatcaggtagcgttactgtaccagtcattggtgaaatgaaatactatgtagatttagagacagataaaggagaagaccgtgtatatcttaataaagaggtctatcataagtttgataaaggtgatgatttctctaatgtaggtgagaaagtgtataagaatgatgaattaatatataaaggagactaactatgtatttaaatgattatgtaggtaaatttataaaggaagataactattatggatatcaatctacagacttagtatctaattatgttcaacgattaactctaggtaggtacaaaactaagttaaatgctaataaaatgaaatacgaaagattacctagttcttggaaaataattaaagccaaagatttgttaagaacagatgattatagagaaggagatatatttgtatcagaaagaatctccgtattcggttttaatggtattattgtatataaccatgattttaacaatgtaactgttattactcaaaatagagatggtaaagctactaatcctgtagaggagcatttatatccaaagaaagatattgattatattattagacctatcgagagggactacagggaatactttaaaaaatcagattcaaaagaaaaagttactctttcgaagcaagaatataaaaaattattagaggcttataataaaatgaaggaagtgtttaagtaatatgaatagtacaaaattagtagagtactttacaaataaacaaggtaaatctctaatattacctgatgaaaataaagttgagttatatagagttgatgtaacaccttatactatgagacttaatttcacttacaatacagaagttgtagctatagatattgataagttacactcagattctatagaaatgcatataccacaaggtctttatataacaactgttgttaaaattactagtacgcagagtattagttcagttcttcataaggtattagaggaatgggtaagacaagtacaaaatgatggtatattcggattcgtatgggagtaattataatgataagtatagaacatgattatacaataagaactgtagataatagaaaatatacttattatagtaaatacgaatcactagttactttgtatgaaaatattatgagtaaagattgtattgaagtaactaaatatgggaaagataaaaaagttattattgatactagacatattgtatctattgaacgatggtaaataataaggaggagtaaactattatgataaatgcagggcatgctaagtacctatcagaaatttatgaagatgatgtacattatgaaactatagatagtattgtagaagatatactagataatattaatgatggtattattgaagaagctatgaaaggtaatacaagttatcaatatgttcttagagacttaagagtagataatgaagtagaatatagagttatagaagaacttactaaccaaggatatagtgtaaaccacattagtaatgatatagagtacccttctatatctacaaataatttagcagggttagattacttaaatattaaatggtaagggagggaattaatatgataaataaatataaaaagttatgggatgaaataactcaacaaattgttaatgtagaaattattaactttaaaaatgaaacagtaacaatagaatctacagatgattcaggattatcagagataagaggttttgaagaagtagagtttatagattactatggataagatgtttaaagtatataatttataaggaggaaacatatggacttgtttgcaaaaataattattatgtctataggagttgttcccttgttaactattattgttgcacagctaattacagattaccatgataatcattaagtattatagtaataggaaggacaatatttagagtgagagtatgttgactaatgaggaagatatagaatgagaacctaaccaagtaaaactaagtacctttgttatgtactactattactactactactattactactactattactactactactactactattactactactattactactactaagtacctttgttatgtactactattactactactattactactactattactactactactactattactactactattactactactaagtacctttgttatgtactactattactactactattactactactaagtacctttgttatgtactactaagtacctttgttatgtactactattactactactaagtacctg

SEQ ID NO: 6 - DNA, 137946 bp, Artificial sequence
  Synthetic polynucleotide
ggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatactctagaatatgcttacacacaagttaaaacaaatagaattagtcaataaaattaaatatgaagcggttgaatataaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttagttgcaacagtcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacaatagatgttaatattaagatacaaggtaagggaagcggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattaactaaagcagaaaacaaagggcaagcaattttaaatggtcgttactttgacggatatagtaaaggtgaacttgaagaaaaatatgcaattgaaattgatggcaacaaattaattatgcgtcattggggtacacaaacaattgagattgacttaagcataaatgagattgtttcatactatggtgaaagcaattcagaccgtgacagtttaaacacacttgtatattgcttaggaattgaaccaaactttagatacttaccaagcaaagacttgttcatttacgaaaattaattaaataaagggcttgactttcaagccctacaatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacccaggtacttattttttgggaaaaattatgaaaataaatatttaaaagtcaacacctaaaatatagaaagtaagtcaacaccctatattaaaagtcaacattataacccctccctgtaagtcaataatttatagtacaaatagacaacctctaaatataaagtcaacatacctaaaataaaaaaagagggaaattaaatccctcctcttaggtattattaacaaactctaattcatgtatagtaatcatatccattccatagaaatctcttgggtctcctttaatgaactcttgctcacctctatggtttgtttcctctttataaccttcttctttaatacgtttaattaagttctccttatctgtatatatcttatcttctctaaaatggaagttatcttcataaggttcacaattatcatgttctacttggtatagtttcatattacttattctccttgattttttttagatagttttcataataagctcttgattcttgtgttaacttttctctttcttctctagaccattgtaatgctccccaaaatttctcataattttcttttgataagtcacctagtggactgcccttaggtaagtctttagtagcttctttttgtattttttctctttcttttttaatttcatctagtttttcttgattacctttaaatgtgactcttggtttggatagtaagaattctagtatttcttcatctgtaaatacctttgcataactatctttccatgtagtatcttcataagagtgtttacctgtatcttctaattcttttaacgccaattttgagtaaccttttgcatctataagccctctagtatacatacttgcagggtctaagaattttatttggttctcataattaataatacttgtttcgagtttaagtttggcttgttctttgttcatacttaatcctccttatacatttacactcatgattaagtaaaagtcatagaatttaccttcatattgttctacattgtatatatgagacattaatctataataatattctgcatcatgtgtacctttaaacgttttttcattaaactcatttttcattagattaactaacttgtctttagttagtacgaatacaccttcacaccattcttcaaactcatcataatatgtctctgcatctcttaaaagtaagtccataaaatatcctggttttctaaagtcatcttcaaagttaaatcctttataataattcttttctaatatatgtctatacctagcgttattaataaagtgctgtaagcctttctgttccacttttctattacttaatgtcacaccgattacttcaaagtctagtcccattatttttcctcctcttcataagaccacgtaccatattctgcattatagtgtgctgtatctgcaccttcatcttcatattctacactataccatgcatcctcctctgtttctgcatctatatatcttacctcttctgtagtaatagtacgttttactttgtatcttttcaactgtttttcctcctttatgttttcctctagtatttgttttaatgtctgacagtctttttggtctagagtatcccaactctctagattttgtaattgataaagtaactcatttacaatttcatcgaaggcttctgcttttttatatacttcttctagttctgtttctgctaattttctattccttttaatttgttctgctttagttactaagatatgggctttattcatttcctctataataaagtttttatagttttccattattatttatccctcctattttctatccgttgttttatctcttctctattgcggtggtgctccttactcatttctttacgttccttatttgttaaccttattctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctaggaatacagaaaatataattaacattatagggagggctacaagaaaacctagcccctgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattttctaatactaaatcaatatatttgatattcattttaactctccttttatattaataattctttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtaaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgtttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctaccctcttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggatttaaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagtactcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttctcagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatctgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaattcaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaacgcaaagtgtctgtatacattccctacaaatgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtaccgtagagggtgtggatattgattatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacaaaatggcagttaccaatttgtttgtcaaaaatgtggtaaaccactagatagatggtataacggtgagtggcattgtaagtaccctgagcgtacaaaaggtaataaaggggtacgagggtatctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataacagggttacagtggataaattaatgcagaataaaagatacgtacaagcacttaagacaaaggatataagtgtttatagtacagtagatgatgatttaaaaactttcttaaaacattggcaaaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatattttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagagctatttctaatggtgaagaaggaaaggtaaaccctaaaaaagtagcaaattcattatctaatttaagtaaaaaaggtgtagatgtatcccatattaatacaaactcatcattgtataaagagtttgttgatgataacggtgatacaataggaattacatcttttaaacgaactgaaaatgatataatattagaatcttatgcaagttcacctgattcagatggtgtaggagcaagagctattatggaattattacgtttaagtattaaagaaaataaaaatgcagttgtgtatgacatagaattacctgaagcaatagagtatttaaaaactttaggatttaaacctaataaagatggatacattttaagaaaaaaagatgtaaaacaattcttaggtgattatagtgattttatttagcactatagtcatctattctattgtatttattttatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagtaaagaggagaaagaagatagtattaaagaatttagtagtttattatgtgaaatggtaaatagactatacaagtcttataatgtatttagacaagaccctatggatgaaactcaacgtctagatggctctttaatggtctttcaaagtagattaaatgaccctttaacaggagatttacatgataagatgtataaacttgctttttcaaaacgcattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaaccatctgaaccgtctgacaatcctgatgaaaatggaggatgggaaactgaaccaactgaacctgagtcaccttcagagccggacgataaagtggacgaagaggataaaaatgaagatactacagatgataaacagcccactgaacaaccggacgataacaacatagataatgaagataaaactgaagaggagtaattactcctctttttttgtttgctatattaaataagagctaaatataaaaaaattgaacattacggtggtgaaaactttgttaggaatgaatattataacgtcactatcagtagtatttacctgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttattataagttttataggtgcaatacttggaggaatttggtacaagatgatgaaaattattaaaaaaagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaagaagatgttttattacattgaagaaccgtttgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaaaaacgaacataacttacatgatattttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaggaaatgaaacgcatagaagattttattgttaatacaggtaaagataaagatgtagatagagattcatttcaaactttctgtaagaaaattgttagagatacttatatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagaattagctatgggtataagaaaccctagaactgaattatcttcttcaggatacggattatcagaagtagaaatagctatgaaagaatttattgcctacaataatacggaatcatttaatgatagatttttctcacatggtggtactactagaggtattttacagatacggtcagaccaacaacaatcacaacatgcattagagaactttaagcgtgaatggaaatctagtttatcaggtattaatggttcatggcaaattccagtggtaatggcagatgatattaaatttgtaaatatgacacctactgctaacgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgccagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcattaagtgaaactaatagaccgatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaagatgctcaatccggaaaactatctaaagaagagttagctaagaaagctaagaaaatggaaaaagaaggtaaaaaagaaggagaagataacgccactgattataaagaatctaaatcaggaaaaaatgaccaaaataaatcgaagactgatgataaagcagaagatacttatgatatggctcaaccactaagagatgctcatagtgctttagcaggtcttcctgcccctatatatttagctataggagctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataacagtcaatgttaatgttcaaggtggaaataatcctgaagaaactggagacattatcggaggaagaattagagaagttctagatagtaatatggatatctttgcaaatgaacataagagaagttattagtaattttgtattgacacaagagtagtatcataatatactactcttatacatataaaaaataaaaggaagtatgtgtatatgcgtagaataagaagacctaaggtaagaatagaaatcgttacagatgataatacatttacattgagatttgaagatacacgtgactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcgagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaatgccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacaaaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgatagtcatggtatatatttatacagtaatactaagggaattgttgttagtggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaatttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtaaaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattataggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattatagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaagaatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtataataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggcagaggtataactttagaacaaattattaataataatataggttatgttattaatgggagcttttataaagttgacggggaatccaaagtatcattaaggaatagtattatattttttacttatgataatgatggaaattaccagtattggaatacacgaagtatagaaaagaacccttatattaaatctattaatgctcctgctaaacaagatgaagtagggagaaaagatgtcatatttaatttgaatatagcaagaaagaaaaagttcttagttataactgagggtgtatttgatgctttaaccttccatgagtatggcgtagcaacattaggtaaacaagtaactgagaatcaaataaaaaaataattgattatgttagtatagatacatcaatatatattatgttagacactgatgcattagataataatatagacttagcttataagttaaaaacacattttaataaagtttactttgtacctcatggtgatgaagatgcaaatgatatgggaacaaggaaagcttttgagttattaaaacagaaccgggtgctagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataacgagttaaacttaaatattttaattgatgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgaagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtaggtaaagctaaagataaactaaatgaaaaacgagaagcttacctaaaagagaaacaagaagaattacgtcaaaaacaacaagaagaagaacaaaaagaaactgaatctgacagcaatgaaaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataacgttcttttaaacaacagagagccacacacatggtgggagcaagtcattaatgatagtagtaaggtgaataagacaccttgcttaatatttactagaaatagagctcagagttatgttgctttaccttatgatgagaaagtatatgaagatttaagaaataatgaataccctgtcatgagaacagactttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagcaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaacgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgctagtgagtctgttagactagataaattatctattggtgttacaatccctaacaaatttatggagttagttaaagaaggtaaacctttctatacttttgatacttacgacattaataaagtgtacggtaagtatttagatgagctaaacattgatgaatggtatgataagttactagataatgatagtatcggtaaagtaaaacatgatgctagagaagttatgacagatattgctaaaacgcaattagaatcaggctacccttatgtattctatattgataatgctaatgataatcacccattgaaaaacctaggtaaagttaaaatgagtaacttatgtacagaaatttcacaattacaagaggtatcagaaatttatccgtactcttacagtaatcagaatgttattaatagagatgttgtctgtacattaggttctcttaacttggttaatgtggttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagggaagcattagacctagtaaacagtttatatagtgctattaacttccagtctattaagacatctatgttaatggctaaagaaacaggaaaaccatttaaaggctttgagaagtccgattatgctacaggtgaatactttgtaagatatattagagaatccaatcaacctaagacagataaagctaagaaagtcttaaataaggtttatattccaacacaagatgattgggatgaattagctaaagcagtaaaagtacatggcttgtataatggttatagaaaagcagaagcacctactcaatctatatcttatgtacagaatgctacaagttctattatgccagttcctagtgctatagagaatagacaatatggagatatggagacatattacccaatgccttacctaagtcctataactcagttcttctatgaaggagaaacagcttataagattgacaataaacgtattattaatacaagcgcagttgttcagaaacatacagaccaagcagtgtctacaatactttatgtagaatcagaaatccctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcttatagtcatatttttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaatttattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatacagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgttgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgttagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggagaaacaatactctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaatgggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggaaccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataagttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatctcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttgaggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgtagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtagatttgagcattccacttatcctcctgatgaggggtttgcgtatgtagattatgtagatgtgattcttattggtgtagataatcctaggaaaagaaagattattaccttaaaagtaaatgagttcaacccggatgactacagagtaggtcataagtacaatattataaaaatactatggtttgaaaaatgggaatggttaaagccataagtaaaaggagagaaataaaatgattatagataaattaaatggagttaaattagaaataggtgggcatgtcgtatcatttagtgtaagaaagtttaatacaattaatggtgagagacaattaatagactaccatcatattaaaagaaatagacaacagtactttagaactactgaagaattttataatgaatataaagaaattaagcctgacaaaaatgaaatagatgaaatgtttgaatctctaggttatgtagatactgagttagatgatgtagtaagaaaccaggaaaaggttactgaaatattaggagttagtgaacaatatttaaatcagttatcttataaagctatagaggagtatgtagataaagtagttacacttgaaattaaagagttgaaaggagagaaatagcatgaataataactgggaaaaagaaggagttaactattgggaaaaagaaggagttaactattgggaaaacgaagactgtcctagggaatacttagagaaagcattcattgacctggtagaatatgttgaaggagttacagtaccacctaaagatgttaagcagttaagagaagataaacttagagaagatattgggttttatgagtacgtagctgataaataaattagtatctacctattgacttaggtaggtatctattatataatagtatacaaggagatgaaaatatgaaaaagttaatagtattacttacaattactatttctctattactagggggttgctctcctgataaccatgaaggtaaagtagtaggagtaggtgaatacagagaaccaactacttatataaaatcaggtagcgttactgtaccagtcattggtgaaatgaaatactatgtagatttagagacagataaaggagaagaccgtgtatatcttaataaagaggtctatcataagtttgataaaggtgatgatttctctaatgtaggtgagaaagtgtataagaatgatgaattaatatataaaggagactaactatgtatttaaatgattatgtaggtaaatttataaaggaagataactattatggatatcaatctacagacttagtatctaattatgttcaacgattaactctaggtaggtacaaaactaagttaaatgctaataaaatgaaatacgaaagattacctagttcttggaaaataattaaagccaaagatttgttaagaacagatgattatagagaaggagatatatttgtatcagaaagaatctccgtattcggttttaatggtattattgtatataaccatgattttaacaatgtaactgttattactcaaaatagagatggtaaagctactaatcctgtagaggagcatttatatccaaagaaagatattgattatattattagacctatcgagagggactacagggaatactttaaaaaatcagattcaaaagaaaaagttactctttcgaagcaagaatataaaaaattattagaggcttataataaaatgaaggaagtgtttaagtaatatgaatagtacaaaattagtagagtactttacaaataaacaaggtaaatctctaatattacctgatgaaaataaagttgagttatatagagttgatgtaacaccttatactatgagacttaatttcacttacaatacagaagttgtagctatagatattgataagttacactcagattctatagaaatgcatataccacaaggtctttatataacaactgttgttaaaattactagtacgcagagtattagttcagttcttcataaggtattagaggaatgggtaagacaagtacaaaatgatggtatattcggattcgtatgggagtaattataatgataagtatagaacatgattatacaataagaactgtagataatagaaaatatacttattatagtaaatacgaatcactagttactttgtatgaaaatattatgagtaaagattgtattgaagtaactaaatatgggaaagataaaaaagttattattgatactagacatattgtatctattgaacgatggtaaataataaggaggagtaaactattatgataaatgcagggcatgctaagtacctatcagaaatttatgaagatgatgtacattatgaaactatagatagtattgtagaagatatactagataatattaatgatggtattattgaagaagctatgaaaggtaatacaagttatcaatatgttcttagagacttaagagtagataatgaagtagaatatagagttatagaagaacttactaaccaaggatatagtgtaaaccacattagtaatgatatagagtacccttctatatctacaaataatttagcagggttagattacttaaatattaaatggtaagggagggaattaatatgataaataaatataaaaagttatgggatgaaataactcaacaaattgttaatgtagaaattattaactttaaaaatgaaacagtaacaatagaatctacagatgattcaggattatcagagataagaggttttgaagaagtagagtttatagattactatggataagatgtttaaagtatataatttataaggaggaaacatatggacttgtttgcaaaaataattattatgtctataggagttgttcccttgttaactattattgttgcacagctaattacagattaccatgataatcattaagtattatagtaataggaaggacaatatttagagtgagagtatgttgactaatgaggaagatatagaatgagaacctaaccaagtaaaactaagtacctttgttatgtactactattactactactattactactactattactactactattactactactattactactactattactactactattactactactattactactactattactactactaagtacctttgttatgtactactattactactactattactactactaagtacctttgttatgtactactattactactactattactactaagtacctg

SEQ ID NO: 7 - DNA, 140317 bp, Artificial sequence
  Synthetic polynucleotide
ggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccacacacgcacatatacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatactctagaatatgcttacacacaagttaaaacaaatagaattagtcaataaaattaaatatgaagcggttgaatataaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttagttgcaacagtcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacaatagatgttaatattaagatacaaggtaagggaagcggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattagaaaaagcagaaaacaaagggcaagcaattttaaatggtcgttattatgacggatatagaaacggtgagcttgaggaaaaatatgcaattgaaattgatggcaacaaattagttatgcgtcattggggtacacaaacaattgagattgacttaagcataaatgagattgtttcatattacggtgaaagcaactcagaccgtgacagtttaaacacacttgtatattgcttaggaattgaaccaaactttagatacttaccaagcaaagacttgttcatttacgaaaattaattaaataaagggcttgactttcaagccctacaatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacccaggtacttattttttgggaaaaattatgaaaataaatatttaaaagtcaacacctaaaatatagaaagtaagtcaacaccctatattaaaagtcaacattataacccctccctgtaagtcaataatttatagtacaaatagacaacctctaaatataaagtcaacatacctaaaataaaaaaagagggaaattaaatccctcctcttaggtattattaacaaactctaattcatgtatagtaatcatatccattccatagaaatctcttgggtctcctttaatgaactcttgctcacctctatggtttgtttcctctttataaccttcttctttaatacgtttaattaagttctccttatctgtatatatcttatcttctctaaaatggaagttatcttcataaggttcacaattatcatgttctacttggtatagtttcatattacttattctccttgattttttttagatagttttcataataagctcttgattcttgtgttaacttttctctttcttctctagaccattgtaatgctccccaaaatttctcataattttcttttgataagtcacctagtggactgcccttaggtaagtctttagtagcttctttttgtattttttctctttcttttttaatttcatctagtttttcttgattacctttaaatgtgactcttggtttggatagtaagaattctagtatttcttcatctgtaaatacctttgcataactatctttccatgtagtatcttcataagagtgtttacctgtatcttctaattcttttaacgccaattttgagtaaccttttgcatctataagccctctagtatacatacttgcagggtctaagaattttatttggttctcataattaataatacttgtttcgagtttaagtttggcttgttctttgttcatacttaatcctccttatacatttacactcatgattaagtaaaagtcatagaatttaccttcatattgttctacattgtatatatgagacattaatctataataatattctgcatcatgtgtacctttaaacgttttttcattaaactcatttttcattagattaactaacttgtctttagttagtacgaatacaccttcacaccattcttcaaactcatcataatatgtctctgcatctcttaaaagtaagtccataaaatatcctggttttctaaagtcatcttcaaagttaaatcctttataataattcttttctaatatatgtctatacctagcgttattaataaagtgctgtaagcctttctgttccacttttctattacttaatgtcacaccgattacttcaaagtctagtcccattatttttcctcctcttcataagaccacgtaccatattctgcattatagtgtgctgtatctgcaccttcatcttcatattctacactataccatgcatcctcctctgtttctgcatctatatatcttacctcttctgtagtaatagtacgttttactttgtatcttttcaactgtttttcctcctttatgttttcctctagtatttgttttaatgtctgacagtctttttggtctagagtatcccaactctctagattttgtaattgataaagtaactcatttacaatttcatcgaaggcttctgcttttttatatacttcttctagttctgtttctgctaattttctattccttttaatttgttctgctttagttactaagatatgggctttattcatttcctctataataaagtttttatagttttccattattatttatccctcctattttctatccgttgttttatctcttctctattgcggtggtgctccttactcatttctttacgttccttatttgttaaccttattctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctaggaatacagaaaatataattaacattatagggagggctacaagaaaacctagcccctgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattttctaatactaaatcaatatatttgatattcattttaactctccttttatattaataattctttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtaaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgtttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctaccctcttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagatttttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggatttaaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctcttttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagtactcctattatagttatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttctcagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgttttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatctgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaattcaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccgtaaattttgttgcggtctctaaactctgttaaacgggcatagtaaaataatgtatagaaaaataatatactggtaagaaaccctaaatctgactatacacagacagtgggaaccaaccgtgctaaatctgtaatttaattattgacaaaataacaatatatgatataattatattatagtaaaagcctaacgactaaatttctagttatctatataaatggatatagtgagaactagataagaaaattaactatacttaaaaaaactaaaatattttaaaagagaggtgaaaacagttgacattagaaaagagaaaacaagaatatcttaagaagttaaagcaaattaaaaatgatgagtttgaattgctaggaggatttactaaaacaagagagaaagctttatttaaacataaagtttgtggttatgaatggtatactactccttataatttattgaagtctaaagggacaggatgtcctaaatgtcaatacagagataaatcatatactactgatgaatttaaaaagaaacttaaagataaatttggttatgaatatgagttaatagaaggacaagagtataaaaatagtagagaaaaattattgtttattcataataagtgcggtactgaatttaaaattacaagtgatagtttatttcgaagtaaagtaccttgtcataaatgttctaaagaaaatagaaaaactaaaaagaaaacaacagaacagtttaaaaatgaattgtataataaacataaagatgaatatatacttgttgaagggtcagaatataagacagctcttgaaaaggttagaataattcatacgaaatgtggatatacatgggatgttagagcctcacatattttgcatactagtaaatgtcctaattgtaatgagtctaaaggtgagagtttaattaaagacattcttgaagataataatttttcttatataagagagtatacttttgaagatttaaagaatgttaaaaaattaccttttgattttgcactattcattgataatgaattagtaggtttaattgaatatgatggttctcaacactttattccttttgaacactttggaggtaaggaaaaattaagaaaaactcaatataacgatagaaagaaaaatgagtattgtgataagaacagaattccgttaaagagaataaagtatgatttagatgaaaaagaagtaataagagaaatagaaatgtttttaaatagtatagttaaaagtaaagcagagagttattaaccaaaaatagtaactatgatatagtctaatccctaagtaaatattgagaaatcaagggtataaatgggcaagttaaaatagtaaatgatactcatcctaataaggctgtaataaaatcacgtcagttaggtcttagtgaaatgggtgtaatggaaatggttcattttgcagatatgcatagttatgctaacgcaaagtgtctgtatacattccctacaaatgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtaccgtagagggtgtggatattgattatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacaaaatggcagttaccaatttgtttgtcaaaaatgtggtaaaccactagatagatggtataacggtgagtggcattgtaagtaccctgagcgtacaaaaggtaataaaggggtacgagggtatctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataacagggttacagtggataaattaatgcagaataaaagatacgtacaagcacttaagacaaaggatataagtgtttatagtacagtagatgatgatttaaaaactttcttaaaacattggcaaaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatattttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagagctatttctaatggtgaagaaggaaaggtaaaccctaaaaaagtagcaaattcattatctaatttaagtaaaaaaggtgtagatgtatcccatattaatacaaactcatcattgtataaagagtttgttgatgataacggtgatacaataggaattacatcttttaaacgaactgaaaatgatataatattagaatcttatgcaagttcacctgattcagatggtgtaggagcaagagctattatggaattattacgtttaagtattaaagaaaataaaaatgcagttgtgtatgacatagaattacctgaagcaatagagtatttaaaaactttaggatttaaacctaataaagatggatacattttaagaaaaaaagatgtaaaacaattcttaggtgattatagtgattttatttagcactatagtcatctattctattgtatttattttatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagcaaagaggagaaagaagatagtattaaagaatttagcagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgcattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaaccatctgaaccgtctgacaatcctgatgaaaatggaggatgggaaacggaaccaactgaacctgagtcaccttcagagccggacgataaagtggacgaagaggataaaaatgaagatactacagatgataaacagcccactgaacaaccggacgataacaacatagataatgaagataaaactgaagaggagtaattactcctctttttttgtttgctatattaaataagagctaaatataaaaaaattgaacattacggtggtgaaaactttgttaggaatgaatattataacgtcactatcagtagtatttacctgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttattataagttttataggtgcaatacttggaggaatttggtacaagatgatgaaaattattaaaaaaagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaagaagatgttttattacattgaagaaccgtttgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaggaaatgaaacgcatagaagattttattgttaatacaggtaaagataaagatgtagatagagattcatttcaaactttctgtaagaaaattgttagagatacttatatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagaattagctatgggtataagaaaccctagaactgaattatcttcttcaggatacggattatcagaagtagaaatagctatgaaagaatttattgcctacaataatacggaatcatttaatgatagatttttctcacatggtggtactactagaggtattttacagatacggtcagaccaacaacaatcacaacatgcattagagaactttaagcgtgaatggaaatctagtttatcaggtattaatggttcatggcaaattccagtggtaatggcagatgatattaaatttgtaaatatgacacctactgctaacgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattaaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgccagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcattaagtgaaactaatagaccgatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaagatgctcaatccggaaaactatctaaagaagagttagctaagaaagctaagaaaatggaaaaagaaggtaaaaaagaaggagaagataacgccactgattataaagaatctaaatcaggaaaaaatgaccaaaataaatcgaagactgatgataaagcagaagatacttatgatatggctcaaccactaagagatgctcatagtgctttagcaggtcttcctgcccctatatatttagctataggagctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataacagtcaatgttaatgttcaaggtggaaataatcctgaagaaactggagacattatcggaggaagaattagagaagttctagatagtaatatggatatctttgcaaatgaacataagagaagttattagtaattttgtattgacacaagagtagtatcataatatactactcttatacatataaaaaataaaaggaagtatgtgtatatgcgtagaataagaagacctaaggtaagaatagaaatcgttacagatgataatacatttacattgagatttgaagatacacgtgactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcgagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaatgccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacaaaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgatagtcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaaattattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatgggaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtaaaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaataatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtacaataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggcagaggtataactttagaacaaattattaataataatataggttatgttattaatgggagcttttataaagttgatggggaatccaaagtatcattaaggaatagtattatattttttacttatgataatgatggaaattaccagtattggaatacacgaagtatagaaaagaacccgtatattaaatctatcaatgcccctgctaaacaagatgaagtaggtagaaaagatgtcatatttaatttgaatatagcaagaaagaaaaagttcttagttataactgagggtgtatttgatgctttaaccttccatgagtatggcgtagcaacattaggtaaacaagtaactgagaatcaaataaaaaaaataattgattatgttagtatagatacatcaatatatattatgttagacactgatgcattagataataatatagacttagcttataagttaaaaacacattttaataaagtttactttgtacctcatggtgatgaagatgcaaatgatatgggaacaaggaaagcttttgagttattaaaacagaaccgggtgctagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataacgagttaaacttaaatattttaattgatgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgaagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtaggtaaagctaaagataaactaaatgaaaaacgagaagcttacctaaaagagaaacaagaagaattacgtcaaaaacaacaagaagaggcacagaaaaaaactgaatctgacagcaatgaaaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataacgttcttttaaacaacagagagccacacacatggtgggagcaagtcattaatgatagtagtaaggtgaataagacaccttgcttaatatttactagaaatagagctcagagttatgttgctttaccttatgatgagaaagtatatgaagatttaagaaataatgaataccctgtcatgagaacagactttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagcaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggcacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaaggttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgctagtgagtctgttagactagataaattatctattggtgttacaatccctaacaaatttatggagttagttaaagaaggtaaacctttctatacttttgatacttacgacattaataaagtgtacggtaagtatttagatgagctaaacattgatgaatggtatgataagttactaaataatgatagtatcggtaaagtaaaacatgatgctagagaagttatgacagacattgctaaaacacaattagaatcaggctacccttatgtattctatattgataatgctaatgataatcacccattgaaaaacctaggtaaagttaaaatgagtaacttatgtacagaaatttcacaattacaagaggtatcagaaatttatccgtactcttacagtaatcagaatgttattaatagagatgttgtctgtacattaggttctcttaacttggttaatgtggttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagggaagcattagacctagtaaacagtttatatagtgctattaacttccagtctattaagacatctatgttaatggctaaagaaacaggaaaaccatttaaaggctttgagaagtccgattacgctacaggtgaatactttgtaagatacattagagaatccaatcaacctaagacagataaagctaagaaagtcttaaataaggtttatattccaacacaagatgattgggatgaattagctaaagcagtaaaagtacatggtttgtataatggttaccgaaaagcagaagcacctactcaatctatatcttatgtacagaatgctacaagttctattatgccagtacctagtgctatagagaatagacaatatggagatatggagacatattacccaatgccttacctaagtcctataactcagttcttctatgaaggagaaacagcttataagattgacaataaacgtattattaatacaagcgcagttgttcagaaacatacagaccaagcagtgtctacaatactttatgtagaatcagaaatccctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcttatagtcatatttttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaatttattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatgcagacaaaacgtaattcatttactaagaaattacttaatatgattaataaacaaaaacgaacattatatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggttgccttaaatagccacagtgacttgtaaagagttattacaaaaccatgtgaattgctgggaagccttaaagacttattaactacaacgtaactggaaacagtaggcgtgaatgtttaaaaataataagtatatgagttatatggtataacgaaaaatctttgttatattatatagtgtaggtaatcagcatccaagcttctaagttgaaaaataagaagaaggttcaacgactatcgaaaagatatctagtaccgagaggtattagagagtaactgagtagagtaaaagatattaatctttgaagtgcatgggaattgcctacgaaatctattagaaaaatggagagtagtataatatggtaaaacgagtttggactaatgaagagaaacaagatatagtaaaatcatttcaagaaggtaaaacgtttaaagaattacaagataagtataatgcacattatttcactatcaagaaaattttagatgagtttaatattgacacaaataaaaaacgaagatggactaataagcaaaaacaagatatactaagaatgtatactaaagagtctatgactatagcagagataaaaaaggtatatacaacacacgcaagagaaataggtagaatactaaaagactttggagtagatacttcttactatcaaactagaagcgttaatagaaatataaatagaaatttctttgaagtaattgatactgaagagaaagcttatatactaggtttattaatggctgatgggtgtgttagatatagacgagaagggcaatgttacttaacactagaattgattgataaagaaatagtaaaaagagttcaaaaagaattgaattcagacagtaaaatatatgaatcacatagaaaaagagattatataaaaaacgaaaaacaaacttatacttttagtgttaccgatgaaaaactatgtaatgacttagctaaatatggtatagtacctatgaagtctaaaaaaacagaatgtttaacacaagatataccttatgatttaagaaaacattacttaagaggattgtttgacggtgatggttctatcgggtattataataatagatggtttataactttaattaataatcatcctgaatttttaaaagatgtaggtacttggattgatgatttattaggtttaaaatgtcctaaagtatctaaaactagtacctcttatagaataggttatacaggtaaaaaagctaaagaattaatgaaattactatatcaagataataatattcatataatccgaaaacaaaaacttgcagaccaggcaattcaagatatagtctaagcccactattaaattagtgttaaagtactaggaaactaggggtagtaactgaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgttgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgttagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggggaaacaatactctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggcggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggaaccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataggttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatctcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttgaggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtagatttgagcattccacttatcctcctgatgaggggtttgcgtatgtagattatgtagatgtgattcttattggtgtagataatcctaggaaaagaaagattattaccttaaaagtaaatgagttcaacccggatgactacagagtaggtcataagtacaatattataaaaatactatggtttgaaaaatgggaatggttaaagccataagtaaaaggagagaaataaaatgattatagataaattaaatggagttaaattagaaataggtgggcatgtcgtatcatttagtgtaagaaagtttaatacaattaatggtgagagacaattaatagactaccatcatattaaaagaaatagacaacagtactttagaactactgaagaattttataatgaatataaagaaattaagcctgacaaaaatgaaatagatgaaatgtttgaatctctaggttatgtagatactgagttagatgatgtagtaagaaaccaggaaaaggttactgaaatattaggagttagtgaacaatatttaaatcagttatcttataaagctatagaggagtatgtagataaagtagttacacttgaaattaaagagttgaaaggagagaaatagcatgaataataactgggaaaaagaaggagttaactattgggaaaaagaaggagttaactattgggaaaacgaagactgtcctagggaatacttagagaaagcattcattgacctggtagaatatgttgaaggagttacagtaccacctaaagatgttaagcagttaagagaagataaacttagagaagatattgggttttatgagtacgtagctgataaataaattagtatctacctattgacttaggtaggtatctattatataatagtatacaaggagatgaaaatatgaaaaagttaatagtattacttacaattactatttctctattactagggggttgctctcctgataaccatgaaggtaaagtagtaggagtaggtgaatacagagaaccaactacttatataaaatcaggtagcgttactgtaccagtcattggtgaaatgaaatactatgtagatttagagacagataaaggagaagaccgtgtatatcttaataaagaggtctatcataagtttgataaaggtgatgatttctctaatgtaggtgagaaagtgtataagaatgatgaattaatatataaaggagactaactatgtatttaaatgattatgtaggtaaatttataaaggaagataactattatggatatcaatctacagacttagtatctaattatgttcaacgattaactctaggtaggtacaaaactaagttaaatgctaataaaatgaaatacgaaagattacctagttcttggaaaataattaaagccaaagatttgttaagaacagatgattatagagaaggagatatatttgtatcagaaagaatctccgtattcggttttaatggtattattgtatataaccatgattttaacaatgtaactgttattactcaaaatagagatggtaaagctactaatcctgtagaggagcatttatatccaaagaaagatattgattatattattagacctatcgagagggactacagggaatactttaaaaaatcagattcaaaagaaaaagttactctttcgaagcaagaatataaaaaattattagaggcttataataaaatgaaggaagtgtttaagtaatatgaatagtacaaaattagtagagtactttacaaataaacaaggtaaatctctaatattacctgatgaaaataaagttgagttatatagagttgatgtaacaccttatactatgagacttaatttcacttacaatacagaagttgtagctatagatattgataagttacactcagattctatagaaatgcatataccacaaggtctttatataacaactgttgttaaaattactagtacgcagagtattagttcagttcttcataaggtattagaggaatgggtaagacaagtacaaaatgatggtatattcggattcgtatgggagtaattataatgataagtatagaacatgattatacaataagaactgtagataatagaaaatatacttattatagtaaatacgaatcactagttactttgtatgaaaatattatgagtaaagattgtattgaagtaactaaatatgggaaagataaaaaagttattattgatactagacatattgtatctattgaacgatggtaaataataaggaggagtaaactattatgataaatgcagggcatgctaagtacctatcagaaatttatgaagatgatgtacattatgaaaactatagatagtattgtagaagatatactagataatattaatgatggtattattgaagaagctatgaaaggtaatacaagttatcaatatgttcttagagacttaagagtagataatgaagtagaatatagagttatagaagaacttactaaccaaggatatagtgtaaaccacattagtaatgatatagagtacccttctatatctacaaataatttagcagggttagattacttaaatattaaatggtaagagagggaattaatatgataaataaatataaaaagttatgggatgaaataactcaacaaattgttaatgtagaaattattaactttaaaaatgaaacagtaacaatagaatctacagatgattcaggattatcagagataagaggttttgaagaagtagagtttatagattactatgactactattactactactattactactactattactactactattactactactattactactactattactactactattactactactattactactactattactactactactactaagtacctg

SEQ ID NO: 8 - DNA, 140754 bp, Artificial sequence
  Synthetic polynucleotide
ggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccatacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatactctagaatatgcttacacacaagttaaaacaaatagaattagtcaataaaattaaatatgaagcggttgaatataaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttagttgcaacagtcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacaatagatgttaatattaagatacaaggtaagggaagcggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattagaaaaagcagaaaacaaagggcaagcaattttaaacggtcgttactttgacggatatagaaacggtgaacttgaagaaaaatatgcaattgaaattgatggcaacaaattaattatgcgtcattggggtacacaaacaattgagattgacttaagcataaatgagattgtttcatactatggtgaaagcaattcagaccgtgacagtttaaacacacttgtatattgcttaggaattgaaccaaactttagatacttaccaagcaaagacttgttcatttacgaaaattaattaaataaagggcttgactttcaagccctacaatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacccaggtacttattttttgggaaaaattatgaaaataaatatttaaaagtcaacacctaaaatatagaaagtaagtcaacaccctatattaaaagtcaacattataacccctccctgtaagtcaataatttatagtacaaatagacaacctctaaatataaagtcaacatacctaaaataaaaaaagagggaaattaaatccctcctcttaggtattattaacaaactctaattcatgtatagtaatcatatccattccatagaaatctcttgggtctcctttaatgaactcttgctcacctctatggtttgtttcctctttataaccttcttctttaatacgtttaattaagttctccttatctgtatatatcttatcttctctaaaatggaagttatcttcataaggttcacaattatcatgttctacttggtatagtttcatattacttattctccttgattttttttagatagttttcataataagctcttgattcttgtgttaacttttctctttcttctctagaccattgtaatgctccccaaaatttctcataattttcttttgataagtcacctagtggactgcccttaggtaagtctttagtagcttctttttgtattttttctctttcttttttaatttcatctagtttttcttgattacctttaaatgtgactcttggtttggatagtaagaattctagtatttcttcatctgtaaatacctttgcataactatctttccatgtagtatcttcataagagtgtttacctgtatcttctaattcttttaacgccaattttgagtaaccttttgcatctataagccctctagtatacatacttgcagggtctaagaattttatttggttctcataattaataatacttgtttcgagtttaagtttggcttgttctttgttcatacttaatcctccttatacatttacactcatgattaagtaaaagtcatagaatttaccttcatattgttctacattgtatatatgagacattaatctataataatattctgcatcatgtgtacctttaaacgttttttcattaaactcatttttcattagattaactaacttgtctttagttagtacgaatacaccttcacaccattcttcaaactcatcataatatgtctctgcatctcttaaaagtaagtccataaaatatcctggttttctaaagtcatcttcaaagttaaatcctttataataattcttttctaatatatgtctatacctagcgttattaataaagtgctgtaagcctttctgttccacttttctattacttaatgtcacaccgattacttcaaagtctagtcccattatttttcctcctcttcataagaccacgtaccatattctgcattatagtgtgctgtatctgcaccttcatcttcatattctacactataccatgcatcctcctctgtttctgcatctatatatcttacctcttctgtagtaatagtacgttttactttgtatcttttcaactgtttttcctcctttatgttttcctctagtatttgttttaatgtctgacagtctttttggtctagagtatcccaactctctagattttgtaattgataaagtaactcatttacaatttcatcgaaggcttctgcttttttatatacttcttctagttctgtttctgctaattttctattccttttaatttgttctgctttagttactaagatatgggctttattcatttcctctataataaagtttttatagttttccattattatttatccctcctattttctatccgttgttttatctcttctctattgcggtggtgctccttactcatttctttacgttccttatttgttaaccttattctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctaggaatacagaaaatataattaacattatagggagggctacaagaaaacctagcccctgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattttctaatactaaatcaatatatttgatattcattttaactctccttttatattaataattctttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtaaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgtttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctaccctcttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggattttaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaagagaaaaagtacgtatttagaaaataaggagtactcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttctcagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttaatcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatctgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaattcaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccgtaaattttgttgcggtctctaaactctgttaaacgggcatagtaaaataatgtatagaaaaataatatactggtaagaaaccctaaatctgactatacacagacagtgggaaccaaccgtgctaaatctgtaatttaattattgacaaaataacaatatatgatataattatattatagtaaaagcctaacgactaaatttctagttatctatataaatggatatagtgagaactagataagaaaattaactatacttaaaaaaactaaaatattttaaaagagaggtgaaaacagttgacattagaaaagagaaaacaagaatatcttaagaagttaaagcaaattaaaaatgatgagtttgaattgctaggaggatttactaaaacaagagagaaagctttatttaaacataaagtttgtggttatgaatggtatactactccttataatttattgaagtctaaagggacaggatgtcctaaatgtcaatacagagataaatcatatactactgatgaatttaaaaagaaacttaaagataaatttggttatgaatatgagttaatagaaggacaagagtataaaaatagtagagaaaaattattgtttattcataataagtgcggtactgaatttaaaattacaagtgatagtttatttcgaagtaaagtaccttgtcataaatgttctaaagaaaatagaaaaactaaaaagaaaacaacagaacagtttaaaaatgaattgtataataaacataaagatgaatatatacttgttgaagggtcagaatataagacagctcttgaaaaggttagaataattcatacgaaatgtggatatacatgggatgttagagcctcacatattttgcatactagtaaatgtcctaattgtaatgagtctaaaggtgagagtttaattaaagacattcttgaagataataatttttcttatataagagagtatacttttgaagatttaaagaatgttaaaaaattaccttttgattttgcactattcattgataatgaattagtaggtttaattgaatatgatggttctcaacactttattccttttgaacactttggaggtaaggaaaaattaagaaaaactcaatataacgatagaaagaaaaatgagtattgtgataagaacagaattccgttaaagagaataaagtatgatttagatgaaaaagaagtaataagagaaatagaaatgtttttaaatagtatagttaaaagtaaagcagagagttattaaccaaaaatagtaactatgatatagtctaatccctaagtaaatattgagaaatcaagggtataaatgggcaagttaaaatagtaaatgatactcatcctaataaggctgtaataaaatcacgtcagttaggtcttagtgaaatgggtgtaatggaaatggttcattttgcagatatgcatagttatgctaacgcaaagtgtctgtatacattccctacaaatgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtaccgtagagggtgtggatattgattatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacaaaatggcagttaccaatttgtttgtcaaaaatgtggtaaaccactagatagatggtataacggtgagtggcattgtaagtaccctgagcgtacaaaaggtaataaaggggtacgagggtatctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataacagggttacagtggataaattaatgcagaataaaagatacgtacaagcacttaagacaaaggatataagtgtttatagtacagtagatgatgatttaaaaactttcttaaaacattggcaaaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatattttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagagctatttctaatggtgaagaaggaaaggtaaaccctaaaaaagtagcaaattcattatctaatttaagtaaaaaaggtgtagatgtatcccatattaatacaaactcatcattgtataaagagtttgttgatgataacggtgatacaataggaattacatcttttaaacgaactgaaaatgatataatattagaatcttatgcaagttcacctgattcagatggtgtaggagcaagagctattatggaattattacgtttaagtattaaagaaaataaaaatgcagttgtgtatgacatagaattacctgaagcaatagagtatttaaaaactttaggatttaaacctaataaagatggatacattttaagaaaaaaagatgtaaaacaattcttaggtgattatagtgattttatttagcactatagtcatctattctattgtatttattttatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagtaaagaggagaaagaagatagtattaaagaatttagtagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgtattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacctgaacctgaaccatctgaaccgtctgacaatcctgatgaaaatggaggatgggaaacggaaccaactgaacctgagtcaccttcagagccggacgataaagtggacgaagaggataaaaatgaagatactacagatgataaacagcccactgaacaaccggacgataacaacatagataatgaagataaaactgaagaggagtaattactcctctttttttgtttgctatattaaataagagctaaatataaaaaaattgaacattacggtggtgaaaactttgttaggaatgaatattataacgtcactatcagtagtatttacctgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttattataagttttataggtgcaatacttggaggaatttggtacaagatgatgaaaattattaaaaaaagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaagaagatgttttattacattgaagaaccgtttgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaaaaacgaacataacttacatgatattttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaggaaatgaaacgcatagaagattttattgttaatacaggtaaagataaagatgtagatagagattcatttcaaactttctgtaagaaaattgttagagatacttatatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagaattagctatgggtataagaaaccctagaactgaattatcttcttcaggatacggattatcagaagtagaaatagctatgaaagaatttattgcctacaataatacggaatcatttaatgatagatttttctcacatggtggtactactagaggtattttacagatacggtcagaccaacaacaatcacaacatgcattagagaactttaagcgtgaatggaaatctagtttatcaggtattaatggttcatggcaaattccagtggtaatggcagatgatattaaatttgtaaatatgacacctactgctaacgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattaaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgccagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagatgtagaccaacaacgaggaacatttggtagaatggttcaagaacgtttgccatctattggttctcatgctatgatgggtactacagctatggctacaggtttatacatgaagggtgcctcattaagtgaaactaatagaccgatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaagatgctcaatccggaaaactatctaaagaagagttagctaagaaagctaagaaaatggaaaaagaaggtaaaaaagaaggagaagataacgccactgattataaagaatctaaatcaggaaaaaatgaccaaaataaatcgaagactgatgataaagcagaagatacttatgatatggctcaaccactaagagatgctcatagtgctttagcaggtcttcctgcccctatatatttagctataggagctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataacagtcaatgttaatgttcaaggtggaaataatcctgaagaaactggagacattatcggaggaagaattagagaagttctagatagtaatatggatatctttgcaaatgaacataagagaagttattagtaattttgtattgacacaagagtagtatcataatatactactcttatacatataaaaaataaaaggaagtatgtgtatatgcgtagaataagaagacctaaggtaagaatagaaatcgttacagatgataatacatttacattgagatttgaagatacacgtgactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcgagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaatgccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacaaaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgatagtcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaatttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatgggaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtaaaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaataatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtacaataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggcagaggtataactttagaacaaattattaataataatataggttatgttattaatgggagcttttataaagttgatggggaatccaaagtatcattaaggaatagtattatattttttacttatgataatgatggaaattaccagtattggaatacacgaagtatagaaaagaacccgtatattaaatctatcaatgcccctgctaaacaagatgaagtaggtagaaaagatgtcatatttaatttgaatatagcaagaaagaaaaagttcttagttataactgagggtgtatttgatgctttaaccttccatgagtatggcgtagcaacattaggtaaacaagtaactgagaatcaaataaaaaaaataattgattatgttagtatagatacatcaatatatattatgttagacactgatgcattagataataatatagacttagcttataagttaaaaacacattttaataaagtttactttgtacctcatggtgatgaagatgcaaatgatatgggaacaaggaaagcttttgagttattaaaacagaaccgggtgctagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataacgagttaaacttaaatattttaattgatgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgaagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtaggtaaagctaaagataaactaaatgaaaaacgagaagcttacctaaaagagaaacaagaagaattacgtcaaaaacaacaagaagaagaacaaaaagaaactgaatctgacagcaatgaaaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataacgttcttttaaacaacagagagccacacacatggtgggagcaagtcattaatgatagtagtaaggtgaataagacaccttgcttaatatttactagaaatagagctcagagttatgttgctttaccttatgatgagaaagtatatgaagatttaagaaataatgaataccctgtcatgagaacagactttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagcaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaaggttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgctagtgagtctgttagactagataaattatctattggtgttacaatccctaacaaatttatggagttagttaaagaaggtaaacctttctatacttttgatacttacgacattaataaagtgtacggtaagtatttagatgagctaaacattgatgaatggtatgataagttactagataatgatagtatcggtaaagtaaaacatgatgctagagaagttatgacagatattgctaaaacgcaattagaatcaggctacccttatgtattctatattgataatgctaatgataatcacccattgaaaaacctaggtaaagttaaaatgagtaacttatgtacagaaatttcacaattacaagaggtatcagaaatttatccgtactcttacagtaatcagaatgttattaatagagatgttgtctgtacattaggttctcttaacttggttaatgtggttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagggaagcattagacctagtaaacagtttatatagtgctattaacttccagtctattaagacatctatgttaatggctaaagaaacaggaaaaccatttaaaggctttgagaagtccgattatgctacaggtgaatactttgtaagatatattagagaatccaatcaacctaagacagataaagctaagaaagtcttaaataaggtttatattccaacacaagatgattgggatgaattagctaaagcagtaaaagtacatggcttgtataatggttatagaaaagcagaagcacctactcaatctatatcttatgtacagaatgctacaagttctattatgccagttcctagtgctatagagaatagacaatatggagatatggagacatattacccaatgccttacctaagtcctataactcagttcttctatgaaggagaaacagcttataagattgacaataaacgtattattaatacaagcgcagttgttcagaaacatacagaccaagcagtgtctacaatactttatgtagaatcagaaatccctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcttatagtcatatttttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaatttattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatgcagacaaaacgtaattcatttactaagaaattacttaatatgattaataaacaaaaacgaacattatatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggttgccttaactagccacaatgacttgtaaagagttattacaaaaccatgtgaattgctgggaagccttaaagacttattaactacaacgtaactggaaacagtaggcgtgaatgtttaaaaataataagtatatgagttatatggtataacgaaaactttttgttatattatatagtgtaggtaatcagcatccaagcttctaagttgaaaaataagaagaaggttcaacgactatcgaaaagatatctagtaccgagaggtattagagagtaactgagtagagtaaaagatattaatctttgaagtgcatgggaattgcctacgaaatctattagaaaaatggagagtagtataatatggtaaaacgagtttggactaatgaagagaaacaagatatagtaaaatcatttcaagaaggtaaaacgtttaaagaattacaagataagtataatgcacattatttcactatcaagaaaattttagatgagtttaatattgacacaaataaaaaacgaagatggactaataagcaaaaacaagatatactaagaatgtatactaaagagtctatgactatagcagagataaaaaaggtatatacaacacacgcaagagaaataggtagaatactaaaagactttggagtagatacttcttactatcaaactagaagcgttaatagaaatataaatagaaatttctttgaagtaattgatactgaagagaaagcttatatactaggtttattaatggctgatgggtgtgttagatatagacgagaagggcaatgttacttaacactagaattgattgataaagaaatagtaaaaagagttcaaaaagaattgaattcagacagtaaaatatatgaatcacatagaaaaagagattatataaaaaacgaaaaacaaacttatacttttagtgttaccgatgaaaaactatgtaatgacttagctaaatatggtatagtacctatgaagtctaaaaaaacagaatgtttaacacaagatataccttatgatttaagaaaacattacttaagaggattatttgatggtgatggttcaatcgggtattataataatagatggtttataactttaattaataatcatcctgaatttttaaaagatgtaggtacttggattgatgatttattaggtttaaaatgtcctaaagtatctaaaactagtacctcttatagaataggttatacaggtaaaaaagctaaagaattaatgaaattactatatcaagataataatattcatataatccgaaaacaaaaacttgcagaccaggcaattcaagatatagtctaagcccactattaaattagtgttaaagtactgggaaactaggggtagtaactgaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgttgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgttagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggggaaacaatactctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggagccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataggttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatctcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaatgaataaaaggagaaacgtatagtattattgctcatatcaataaacaaactggttggggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtagatttgagcattccacttatcctcctgatgaggggtttgcgtatgtagattatgtagatgtgattcttattggtgtagataatcctaggaaaagaaagattattaccttaaaagtaaatgagttcaacccggatgactacagagtaggtcataagtacaatattataaaaatactatggtttgaaaaatgggaatggttaaagccataagtaaaaggagagaaataaaatgattatagataaattaaatggagttaaattagaaataggtgggcatgtcgtatcatttagtgtaagaaagtttaatacaattaatggtgagagacaattaatagactaccatcatattaaaagaaatagacaacagtactttagaactactgaagaattttataatgaatataaagaaattaagcctgacaaaaatgaaatagatgaaatgtttgaatctctaggttatgtagatactgagttagatgatgtagtaagaaaccaggaaaaggttactgaaatattaggagttagtgaacaatatttaaatcagttatcttataaagctatagaggagtatgtagataaagtagttacacttgaaattaaagagttgaaaggagagaaatagcatgaataataactgggaaaaagaaggagttaactattgggaaaaagaaggagttaactattgggaaaacgaagactgtcctagggaatacttagagaaagcattcattgacctggtagaatatgttgaaggagttacagtaccacctaaagatgttaagcagttaagagaagataaacttagagaagatattgggttttatgagtacgtagctgataaataaattagtatctacctattgacttaggtaggtatctattatataatagtatacaaggagatgaaaatatgaaaaagttaatagtattacttacaattactatttctctattactagggggttgctctcctgataaccatgaaggtaaagtagtaggagtaggtgaatacagagaaccaactacttatataaaatcaggtagcgttactgtaccagtcattggtgaaatgaaatactatgtagatttagagacagataaaggagaagaccgtgtatatcttaataaagaggtctatcataagtttgataaaggtgatgatttctctaatgtaggtgagaaagtgtataagaatgatgaattaatatataaaggagactaactatgtatttaaatgattatgtaggtaaatttataaaggaagataactattatggatatcaatctacagacttagtatctaattatgttcaacgattaactctaggtaggtacaaaactaagttaaatgctaataaaatgaaatacgaaagattacctagttcttggaaaataattaaagccaaagatttgttaagaacagatgattatagagaaggagatatatttgtatcagaaagaatctccgtattcggttttaatggtattattgtatataaccatgattttaacaatgtaactgttattactcaaaatagagatggtaaagctactaatcctgtagaggagcatttatatccaaagaaagatattgattatattattagacctatcgagagggactacagggaatactttaaaaaatcagattcaaaagaaaaagttactctttcgaagcaagaatataaaaaattattagaggcttataataaaatgaaggaagtgtttaagtaatatgaatagtacaaaattagtagagtactttacaaataaacaaggtaaatctctaatattacctgatgaaaataaagttgagttatatagagttgatgtaacaccttatactatgagacttaatttcacttacaatacagaagttgtagctatagatattgataagttacactcagattctatagaaatgcatataccacaaggtctttatataacaactgttgttaaaattactagtacgcagagtattagttcagttcttcataaggtattagaggaatgggtaagacaagtacaaaatgatggtatattcggattcgtatgggagtaattataatgataagtatagaacatgattatacaataagaactgtagataatagaaaatatacttattatagtaaatacgaatcactagttactttgtatgaaaatattatgagtaaagattgtattgaagtaactaaatatgggaaagataaaaaagttattattgatactagacatattgtatctattgaacgatggtaaataataaggaggagtaaactattatgataaatgcagggcatgctaagtacctatcagaaatttatgaagatgatgtacattatgaaactatagatagtattgtagaagatatactagataatattaatgatggtattattgaagaagctatgaaaggtaatacaagttatcaatatgttcttagagacttaagagtagataatgaagtagaatatagagttatagaagaacttactaaccaaggatatagtgtaaaccacattagtaatgatatagagtacccttctatatctacaaataatttagcagggttagattacttaaatattaaatggtaagggagggaattaatatgataaataaatataaaaagttatgggatgaaataactcaacaaattgttaatgtagaaattattaactttaaaaatgaaacagtaacaatagaatctacagatgattcaggattatcagagataagaggttttgaagaagtagagtttatagattactatggataagatgtttaaagtatataatttataaggaggaaacatatggacttgtttgcaaaaataattattatgtctataggagttgttcccttgttaactattattgttgcacagctaattacagattaccatgataatcattaagtattatagtaataggaaggacaatatttagagtgagagtatgttgactaatgaggaagatatagaatgagaacctaaccaagtaaaactaagtacctttgttatgtactactattactactactattactactactattactactactattactactactactattactactattactactactactattactactactattactactactattactattactactactactattactattactactactattactattactactactactactactactattactattactattactactactattactactactaagtacctttgttatgtactactaagtacctttgttatgtactactaagtacctttgttatgtactactaagtacctg

SEQ ID NO: 9 - DNA, 141408 bp, Artificial sequence
  Synthetic polynucleotide
ggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccatacacgcacatatacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatactctagaatatgcttacacacaagttaaaacaaatagaattagtcaataaaattaaatatgaagcggttgaatataaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttagttgcaacagtcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacaatagatgttaatattaagatacaaggtaagggaagcggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattagaaaaagcagaaaacaaagggcaagcaattttaaatggtcgttattatgacggatatagaaacggtgagcttgaagaaaaatatgcaattgaaattgatggcaacaaattagttatgcgtcattggggtacacaaacaattgagattgacttaagcataaatgagattgtttcatattacggtgaaagcaactcagaccgtgacagtttaaacacacttgtatattgcttaggaattgaaccaaactttagatacttaccaagcaaagacttgttcatttacgaaaattaattaaataaagggcttgactttcaagccctacaatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcgcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacccaggtacttattttttgggaaaaattatgaaaataaatatttaaaagtcaacacctaaaatatagaaagtaagtcaacaccctatattaaaagtcaacattataacccctccctgtaagtcaataatttatagtacaaatagacaacctctaaatataaagtcaacatacctaaaataaaaaaagagggaaattaaatccctcctcttaggtattattaacaaactctaattcatgtatagtaatcatatccattccatagaaatctcttgggtctcctttaatgaactcttgctcacctctatggtttgtttcctctttataaccttcttctttaatacgtttaattaagttctccttatctgtatatatcttatcttctctaaaatggaagttatcttcataaggttcacaattatcatgttctacttggtatagtttcatattacttattctccttgattttttttagatagttttcataataagctcttgattcttgtgttaacttttctctttcttctctagaccattgtaatgctccccaaaatttctcataattttcttttgataagtcacctagtggactgcccttaggtaagtctttagtagcttctttttgtattttttctctttcttttttaatttcatctagtttttcttgattacctttaaatgtgactcttggtttggatagtaagaattctagtatttcttcatctgtaaatacctttgcataactatctttccatgtagtatcttcataagagtgtttacctgtatcttctaattcttttaacgccaattttgagtaaccttttgcatctataagccctctagtatacatacttgcagggtctaagaattttatttggttctcataattaataatacttgtttcgagtttaagtttggcttgttctttgttcatacttaatcctccttatacatttacactcatgattaagtaaaagtcatagaatttaccttcatattgttctacattgtatatatgagacattaatctataataatattctgcatcatgtgtacctttaaacgttttttcattaaactcatttttcattagattaactaacttgtctttagttagtacgaatacaccttcacaccattcttcaaactcatcataatatgtctctgcatctcttaaaagtaagtccataaaatatcctggttttctaaagtcatcttcaaagttaaatcctttataataattcttttctaatatatgtctatacctagcgttattaataaagtgctgtaagcctttctgttccacttttctattacttaatgtcacaccgattacttcaaagtctagtcccattatttttcctcctcttcataagaccacgtaccatattctgcattatagtgtgctgtatctgcaccttcatcttcatattctacactataccatgcatcctcctctgtttctgcatctatatatcttacctcttctgtagtaatagtacgttttactttgtatcttttcaactgtttttcctcctttatgttttcctctagtatttgttttaatgtctgacagtctttttggtctagagtatcccaactctctagattttgtaattgataaagtaactcatttacaatttcatcgaaggcttctgcttttttatatacttcttctagttctgtttctgctaattttctattccttttaatttgttctgctttagttactaagatatgggctttattcatttcctctataataaagtttttatagttttccattattatttatccctcctattttctatccgttgttttatctcttctctattgcggtggtgctccttactcatttctttacgttccttatttgttaaccttattctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctaggaatacagaaaatataattaacattatagggagggctacaagaaaacctagcccctgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattttctaatactaaatcaatatatttgatattcattttaactctccttttatattaataattctttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtaaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgtttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctaccctcttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggatttaaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaaggatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagtactcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttctcagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttaatcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatctgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaattcaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccgtaaattttgttgcggtctctaaactctgttaaacgggcatagtaaaataatgtatagaaaaataatatactggtaagaaaccctaaatctgactatacacagacagtgggaaccaaccgtgctaaatctgtaatttaattattgacaaaataacaatatatgatataattatattatagtaaaagcctaacgactaaatttctagttatctatataaatggatatagtgagaactagataagaaaattaactatacttaaaaaaactaaaatattttaaaagagaggtgaaaacagttgacattagaaaagagaaaacaagaatatcttaagaagttaaagcaaattaaaaatgatgagtttgaattgctaggaggatttactaaaacaagagagaaagctttatttaaacataaagtttgtggttatgaatggtatactactccttataatttattgaagtctaaagggacaggatgtcctaaatgtcaatacagagataaatcatatactactgatgaatttaaaaagaaacttaaagataaatttggttatgaatatgagttaatagaaggacaagagtataaaaatagtagagaaaaattattgtttattcataataagtgcggtactgaatttaaaattacaagtgatagtttatttcgaagtaaagtaccttgtcataaatgttctaaagaaaatagaaaaactaaaaagaaaacaacagaacagtttaaaaatgaattgtataataaacataaagatgaatatatacttgttgaagggtcagaatataagacagctcttgaaaaggttagaataattcatacgaaatgtggatatacatgggatgttagagcctcacatattttgcatactagtaaatgtcctaattgtaatgagtctaaaggtgagagtttaattaaagacattcttgaagataataatttttcttatataagagagtatacttttgaagatttaaagaatgttaaaaaattaccttttgattttgcactattcattgataatgaattagtaggtttaattgaatatgatggttctcaacactttattccttttgaacactttggaggtaaggaaaaattaagaaaaactcaatataacgatagaaagaaaaatgagtattgtgataagaacagaattccgttaaagagaataaagtatgatttagatgaaaaagaagtaataagagaaatagaaatgtttttaaatagtatagttaaaagtaaagcagagagttattaaccaaaaatagtaactatgatatagtctaatccctaagtaaatattgagaaatcaagggtataaatgggcaagttaaaatagtaaatgatactcatcctaataaggctgtaataaaatcacgtcagttaggtcttagtgaaatgggtgtaatggaaatggttcattttgcagatatgcatagttatgctaacgcaaagtgtctgtatacattccctacaaatgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtaccgtagagggtgtggatattgattatttatctttagatgagtatgacagggtaaacttattagcagaatcgtctgcattagaatcaatgtcttcatcaccttttaagattgtgagaagatggagcacaccttctgtaccagggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacaaaatggcagttaccaatttgtttgtcaaaaatgtggtaaaccactagatagatggtataatggtgagtggcattgtaagtaccctgagcgtacaaaaggtaataaaggggtacgagggtatctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataacagggttacagtggataaattaatgcagaataaaagatacgtacaagcacttaagacaaaggatataagtgtttatagtacagtagatgatgatttaaaaactttcttaaaacattggcaaaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatattttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagagctatttctaatggtgaagaaggaaaggtaaaccctaaaaaagtagcaaattcattatctaatttaagtaaaaaaggtgtagatgtatcccatattaatacaaactcatcattgtataaagagtttgttgatgataacggtgatacaataggaattacatcttttaaacgaactgaaaatgatataatattagaatcttatgcaagttcacctgattcagatggtgtaggagcaagagctattatggaattattacgtttaagtattaaagaaaataaaaatgcagttgtgtatgacatagaattacctgaagcaatagagtatttaaaaactttaggatttaaacctaataaagatggatacattttaagaaaaaaagatgtaaaacaattcttaggtgattatagtgattttatttagcactatagtcatctattctattgtatttattttatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagtaaagaggagaaagaagatagtattaaagaatttagtagtttattatgtgaaatggtaaatagactatacaagtcttataatgtatttagacaagaccctatggatgaaactcaacgtctagatggctctttaatggtctttcaaagtagattaaatgaccctttaacaggagatttacatgataagatgtataaacttgctttttcaaaacgtattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttcaggttcaggttcaggttcaggttcaggttcaggttcaggttcaggcgtaacttctccaccatttcctcctgtattaccattatctgaaggttcttctcctgggtcaggtttttcttcccaatctcctcctccggtgttaccattatccgaaggttcttccgttgatggtggttcagaatttcctccaccaccggagcctcttccaccatcttcatctgtgtaccctggagggggaggatttggattatctgtatttccttgccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacctgaaccatctgaaccgtctgacaatcctgatgaaaatggaggatgggaaacggaaccaactgaacctgagtcaccttcagagccggacgataaagtggacgaagaggataaaaatgaagatactacagatgataaacagcccactgaacaaccggacgataacaacatagataatgaagataaaactgaagaggagtaattactcctctttttttgtttgctatattaaataagagctaaatataaaaaaattgaacattacggtggtgaaaactttgttaggaatgaatattataacgtcactatcagtagtatttacctgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttattataagttttataggtgcaatacttggaggaatttggtacaagatgatgaaaattattaaaaaaagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaagaagatgttttattacattgaagaaccgtttgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaggaaatgaaacgcatagaagattttattgttaatacaggtaaagataaagatgtagatagagattcatttcaaactttctgtaagaaaattgttagagatacttatatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagaattagctatgggtataagaaaccctagaactgaattatcttcttcaggatacggattatcagaagtagaaatagctatgaaagaatttattgcctacaataatacggaatcatttaatgatagatttttctcacatggtggtactactagaggtattttacagatacggtcagaccaacaacaatcacaacatgcattagagaactttaagcgtgaatggaaatctagtttatcaggtattaatggttcatggcaaattccagtggtaatggcagatgatattaaatttgtaaatatgacacctactgctaacgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaacagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgccagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcattaagtgaaactaatagaccgatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaagatgctcaatccggaaaactatctaaagaagagttagctaagaaagctaagaaaatggaaaaagaaggtaaaaaagaaggagaagataacgccactgattataaagaatctaaatcaggaaaaaatgaccaaaataaatcgaagactgatgataaagcagaagatacttatgatatggctcaaccactaagagatgctcatagtgctttagcaggtcttcctgcccctatatatttagctataggagctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataacagtcaatgttaatgttcaaggtggaaataatcctgaagaaactggagacattatcggaggaagaattagagaagttctagatagtaatatggatatctttgcaaatgaacataagagaagttattagtaattttgtattgacacaagagtagtatcataatatactactcttatacatataaaaaataaaaggaagtatgtgtatatgcgtagaataagaagacctaaggtaagaatagaaatcgttacagatgataatacatttacattgagatttgaagatacacgtgactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcgagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaatgccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacaaaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgatagtcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaatttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatgggaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtaaaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaataatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtataataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggcagaggtataactttagaacaaattattaataataatataggttatgttattaatgggagcttttataaagttgatggggaatccaaagtatcattaaggaatagtattatattttttacttatgataatgatggaaattaccagtattggaatacacgaagtatagaaaagaacccgtatattaaatctatcaatgcccctgctaaacaagatgaagtaggtagaaaagatgtcatatttaatttgaatatagcaagaaagaaaaagttcttagttataactgagggtgtatttgatgctttaaccttccatgagtatggcgtagcaacattaggtaaacaagtaactgagaatcaaataaaaaaaataattgattatgttagtatagatacatcaatatatattatgttagacactgatgcattagataataatatagacttagcttataagttaaaaacacattttaataaagtttactttgtacctcatggtgatgaagatgcaaatgatatgggaacaaggaaagcttttgagttattaaaacagaaccgggtgctagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataacgagttaaacttaaatattttaattgatgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgaagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtaggtaaagctaaagataaactaaatgaaaaacgagaagcttacctaaaagagaaacaagaagaattacgtcaaaaacaacaagaagaggcacagaaaaaaactgaatctgacagcaatgaaaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataacgttcttttaaacaacagagagccacacacatggtgggagcaagtcattaatgatagtagtaaggtgaataagacaccttgcttaatatttactagaaatagagctcagagttatgttgctttaccttatgatgagaaagtatatgaagatttaagaaataatgaataccctgtcatgagaacagactttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagcaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaacgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgccagtgagtctgttagactagataaattatctattggtgttacaatccctaacaaatttatggagttagttaaagaaggtaaacctttctatacttttgatacttacgacattaataaagtgtacggtaagtatttagatgagctaaacattgatgaatggtatgataagttactagataatgatagtatcggtaaagtaaaacatgatgctagagaagttatgacagatattgctaaaacgcaattagaatcaggctacccttatgtattctatattgataatgctaatgataatcacccattgaaaaacctaggtaaagttaaaatgagtaacttatgtacagaaatttcacaattacaagaggtatcagaaatttatccgtactcttacagtaatcagaatgttattaatagagatgttgtctgtacattaggttctcttaacttggttaatgtggttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagggaagcattagacctagtaaacagtttatatagtgctattaacttccagtctattaagacatctatgttaatggctaaagaaacaggaaaaccatttaaaggctttgagaagtccgattatgctacaggtgaatactttgtaagatatattagagaatccaatcaacctaagacagataaagctaagaaagtcttaaataaggtttatattccaacacaagatgattgggatgaattagctaaagcagtgaaagtacatggtttgtataatggttaccgaaaagcagaagcacctactcaatctatatcttatgtacagaatgctacaagttctattatgccagtacctagtgctatagagaatagacaatatggagatatggagacatattacccaatgccttacctaagtcctataactcagttcttctacgaaggagaaacagcttataagattgacaataaacgtattattaatacaagcgcagttgttcagaaacatacagaccaagcagtgtctacaatactttatgtagaatcagaaatccctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcttatagtcatatttttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaatttattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatgcagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacgaccttaactagccacaatgacttgtaaagagttattacaaaaccccttaaagacttattaactacaacgtaactggaaacagtaggcgtgaatgtttaaaaataataagtatatgagttatatggtataacgaaaaatctttgttatattatatagtgtaggtaatcagcatccaagcttctaagttgaaaaataagaagaaggttcaacgactatcgaaaagatatctagtaccgagaggtattagagagtaactgagtagagtaaaagatattaatctttgaagtgcatgggaattgcctacgaaatctattagaaaaatggagagtagtataatatggtaaaacgagtttggactaatgaagagaaacaagatatagtaaaatcatttcaagaaggtaaaacgtttaaagaattacaagataagtataatgcacattatttcactatcaagaaaattttagatgagtttaatattgacacaaataaaaaacgaagatggactaataagcaaaaacaagatatactaagaatgtatactaaagagtctatgactatagcagagataaaaaaggtatatacaacacacgcaagagaaataggtagaatactaaaagactttggagtagatacttcttactatcaaactagaagcgttaatagaaatataaatagaaatttctttgaagtaattgatactgaagagaaagcttatatactaggtttattaatggctgatgggtgtgttagatatagacgagaagggcaatgttacttaacactagaattgattgataaagaaatagtaaaaagagttcaaaaagaattgaattcagacagtaaaatatatgaatcacatagaaaaagagattatataaaaaacgaaaaacaaacttatacttttagtgttaccgatgaaaaactatgtaatgacttagctaaatatggtatagtacctatgaagtctaaaaaaacggattggttaacacaagacataccttataatttaagaaaacattacttaagaggattgtttgacggtgatggttctatcgggtattataataatagatggtttataactttaattaataatcatcctgaatttttaaaagatgtaggtacttggattgatgatttattaggtttaaaatgtcctaaagtatctaaaactagtacctcttatagaataggttatacaggtaaaaaagctaaagaattaatgaaattactatatcaagataataatattcatatagaccgaaagcaaaaacttgcagaccaggcaattcaagatatagtctaagcccactattaaattagtgttaaagtactaggaaactaggggtagtaactgaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatatggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgttgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgttagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggggaaacaatactctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggagccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacccattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataggttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatctcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttggggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtagatttgagcattccacttatcctcctgatgaggggtttgcgtatgtagattatgtagatgtgattcttattggtgtagataatcctaggaaaagaaagattattaccttaaaagtaaatgagttcaacccggatgactacagagtaggtcataagtacaatattataaaaatactatggtttgaaaaatgggaatggttaaagccataagtaaaaggagagaaataaaatgattatagataaattaaatggagttaaattagaaataggtgggcatgtcgtatcatttagtgtaagaaagtttaatacaattaatggtgagagacaattaatagactaccatcatattaaaagaaatagacaacagtactttagaactactgaagaattttataatgaatataaagaaattaagcctgacaaaaatgaaatagatgaaatgtttgaatctctaggttatgtagatactgagttagatgatgtagtaagaaaccaggaaaaggttactgaaatattaggagttagtgaacaatatttaaatcagttatcttataaagctatagaggagtatgtagataaagtagttacacttgaaattaaagagttgaaaggagagaaatagcatgaataataactgggaaaaagaaggagttaactattgggaaaaagaaggagttaactattgggaaaacgaagactgtcctagggaatacttagagaaagcattcattgacctggtagaatatgttgaaggagttacagtaccacctaaagatgttaagcagttaagagaagataaacttagagaagatattgggttttatgagtacgtagctgataaataaattagtatctacctattgacttaggtaggtatctattatataatagtatacaaggagatgaaaatatgaaaaagttaatagtattacttacaattactatttctctattactagggggttgctctcctgataaccatgaaggtaaagtagtaggagtaggtgaatacagagaaccaactacttatataaaatcaggtagcgttactgtaccagtcattggtgaaatgaaatactatgtagatttagagacagataaaggagaagaccgtgtatatcttaataaagaggtctatcataagtttgataaaggtgatgatttctctaatgtaggtgagaaagtgtataagaatgatgaattaatatataaaggagactaactatgtatttaaatgattatgtaggtaaatttataaaggaagataactattatggatatcaatctacagacttagtatctaattatgttcaacgattaactctaggtaggtacaaaactaagttaaatgctaataaaatgaaatacgaaagattacctagttcttggaaaataattaaagccaaagatttgttaagaacagatgattatagagaaggagatatatttgtatcagaaagaatctccgtattcggttttaatggtattattgtatataaccatgattttaacaatgtaactgttattactcaaaatagagatggtaaagctactaatcctgtagaggagcatttatatccaaagaaagatattgattatattattagacctatcgagagggactacagggaatactttaaaaaatcagattcaaaagaaaaagttactctttcgaagcaagaatataaaaaattattagaggcttataataaaatgaaggaagtgtttaagtaatatgaatagtacaaaattagtagagtactttacaaataaacaaggtaaatctctaatattacctgatgaaaataaagttgagttatatagagttgatgtaacaccttatactatgagacttaatttcacttacaatacagaagttgtagctatagatattgataagttacactcagattctatagaaatgcatataccacaaggtctttatataacaactgttgttaaaattactagtacgcagagtattagttcagttcttcataaggtattagaggaatgggtaagacaagtacaaaatgatggtatattcggattcgtatgggagtaattataatgataagtatagaacatgattatacaataagaactgtagataatagaaaatatacttagtatgaaaatattatgagtaaagattgtattgaagtaactaaatatgggaaagataaaaaagttattattgatactagacatattgtatctattgaacgatggtaaataataaggaggagtaaactattatgataaatgcagggcatgctaagtacctatcagaaatttatgaagatgatgtacattatgaaactatagatagtattgtagaagatatactagataatattaatgatggtattattgaagaagctatgaaaggtaatacaagttatcaatatgttcttagagacttaagagtagataatgaagtagaatatagagttatagaagaacttactaaccaaggatatagtgtaaaccacattagtaatgatatagagtacccttctatatctacaaataatttagcagggttagattacttaaatattaaatggtaagggagggaattaatatgataaataaatataaaaagttatgggatgaaataactcaacaaattgttaatgtagaaattattaactttaaaaatgaaacagtaacaatagaatctacagatgattcaggattatcagagataagaggttttgaagaagtagagtttatagattactatggataagatgtttaaagtatataatttataaggaggaaacatatggacttgtttgcaaaaataattattatgtctataggagttgttcccttgttaactattattgttgcacagctaattacagattaccatgataatcattaagtattatagtaataggaaggacaatatttagagtgagagtatgttgactaatgaggaagatatagaatgagaacctaaccaagtaaaactaagtacctttgttatgtactactattactactactattactactactattactactactattactactactattactactactattactattactactaagtactattactattactattactattactattactattactactactattactactactattactactactattactactactattactactactattactactactaactactactattactactactaagtacctttgttatgtactactattactactactattactactactattactattactactattactattactattactattactaagtacctttgttatgtactactattactactactattactattactaagtacctg

SEQ ID NO: 10 - DNA, 140744 bp, Artificial sequence
  Synthetic polynucleotide
ggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctattacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttgtaaaagaggattataataaagaaacattaaggagtttacttgagtatattaatgatactgtaggtagggaattaacttatggtattaatacagactatgataaggatgtcgtgattgaaaccgatgaccctatagatgaggaggatacaattgagttatcaggtacaaacatgttcaaggatgacttatgtattcttatagaagagctatactgtaaggcatttgttaatggtgaacctgttattatacgtaagtatgtagaggagatgttataatgattataatatttttaactgaaaaatatgatgccaaggctttaaagaaagtattagaacatattgataattgtagtagtagaggtcttagctatttaatgggaaaaggagaagcggatgtatgtatagagaaaaatgtatttagagaaagagatgatgtaaggattaactcaaacattattgatgaaggtaaactttgtatactaataaatagacatggtttagaatgtagctactatagaggtatatcatgtaatattggttccttcgtaaaggagagattataatgatagagatataccttagtgaaaattatgataagaatttactaaaagcagaattaaaatggattaaagagaccgcttcaagagaactaacttatgatgttaatagaagtccaggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattataaacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcctagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaattggagatgatttaaatggatgtaaaagaaattgcaaatactataatggagttgtggcaaatggacggctacagatgtgcagaacctccattatatgaaagcacactaaaccatacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgcatttcatggatttagatattaaactagcagactatgacaacatcaataaactatacggctttaaaaaatatactgctaaatggtttggcggtggtgtagtattccaaagttataatatagcggatactctagaatatgcttacacacaagttaaaacaaatagaattagtcaataaaattaaatatgaagcggttgaatataaccgcttctgaattaaataaaaaaattatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccactctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaatttaaatggaaaaacaaaacaatcaaatcaacacaaaaaacagataacattctcttacttattatagggggtttagttgcaacagtcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacaatagatgttaatattaagatacaaggtaagggaagcggtcaaccgcttccaacctaaataaaaaaagtttaaaaaaaactattgacagtcacttgaaaccatgatattattaagataacaaaaaacaaacagaaaaggaattgattataatgaaatttatcaaaactatcgaaaacttattagaaaaagcagaaaacaaagggcaagcaattttaaacggtcgttactttgacggatatagaaacggtgaacttgaagaaaaatatgcaattgaaattgatggcaacaaattaattatgcgtcattggggtacacaaacaattgagattgacttaagcataaatgagattgtttcatactatggtgaaagcaattcagaccgtgacagtttaaacacacttgtatattgcttaggaattgaaccaaactttagatacttaccaagcaaagacttgttcatttacgaaaattaattaaataaagggcttgactttcaagccctacaatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatggtataatgaacttaacaaattaaaagaaaaggaaatgatgaacatgagaaacttattagagcaggaacaattagaaaaagatgtaaaagacattatttgggtattagatagaatgattgctaaaggagaacaatacactgaagcttacgatattttagttaacaaattagaaagacaagaaaaaagaatcgtagaaataaaaaaacaaaatggaatattttaaataacaaatagagggaataaaatccctcttttatttttatcctattatataatttttttatattatacgggggcaggggtaaaatgccactcaatgggggtgggtctatatacccctatggtctacccaggtacttattttttgggaaaaattatgaaaataaatatttaaaagtcaacacctaaaatatagaaagtaagtcaacaccctatattaaaagtcaacattataacccctccctgtaagtcaataatttatagtacaaatagacaacctctaaatataaagtcaacatacctaaaataaaaaaagagggaaattaaatccctcctcttaggtattattaacaaactctaattcatgtatagtaatcatatccattccatagaaatctcttgggtctcctttaatgaactcttgctcacctctatggtttgtttcctctttataaccttcttctttaatacgtttaattaagttctccttatctgtatatatcttatcttctctaaaatggaagttatcttcataaggttcacaattatcatgttctacttggtatagtttcatattacttattctccttgattttttttagatagttttcataataagctcttgattcttgtgttaacttttctctttcttctctagaccattgtaatgctccccaaaatttctcataattttcttttgataagtcacctagtggactgcccttaggtaagtctttagtagcttctttttgtattttttctctttcttttttaatttcatctagtttttcttgattacctttaaatgtgactcttggtttggatagtaagaattctagtatttcttcatctgtaaatacctttgcataactatctttccatgtagtatcttcataagagtgtttacctgtatcttctaattcttttaacgccaattttgagtaaccttttgcatctataagccctctagtatacatacttgcagggtctaagaattttatttggttctcataattaataatacttgtttcgagtttaagtttggcttgttctttgttcatacttaatcctccttatacatttacactcatgattaagtaaaagtcatagaatttaccttcatattgttctacattgtatatatgagacattaatctataataatattctgcatcatgtgtacctttaaacgttttttcattaaactcatttttcattagattaactaacttgtctttagttagtacgaatacaccttcacaccattcttcaaactcatcataatatgtctctgcatctcttaaaagtaagtccataaaatatcctggttttctaaagtcatcttcaaagttaaatcctttataataattcttttctaatatatgtctatacctagcgttattaataaagtgctgtaagcctttctgttccacttttctattacttaatgtcacaccgattacttcaaagtctagtcccattatttttcctcctcttcataagaccacgtaccatattctgcattatagtgtgctgtatctgcaccttcatcttcatattctacactataccatgcatcctcctctgtttctgcatctatatatcttacctcttctgtagtaatagtacgttttactttgtatcttttcaactgtttttcctcctttatgttttcctctagtatttgttttaatgtctgacagtctttttggtctagagtatcccaactctctagattttgtaattgataaagtaactcatttacaatttcatcgaaggcttctgcttttttatatacttcttctagttctgtttctgctaattttctattccttttaatttgttctgctttagttactaagatatgggctttattcatttcctctataataaagtttttatagttttccattattatttatccctcctattttctatccgttgttttatctcttctctattgcggtggtgctccttactcatttctttacgttccttatttgttaaccttattctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctaggaatacagaaaatataattaacattatagggagggctacaagaaaacctagcccctgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattttctaatactaaatcaatatatttgatattcattttaactctccttttatattaataattctttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtaaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgtttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctaccctcttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggattttaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaagagaaaaagtacgtatttagaaaataaggagtactcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttctcagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttaatcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatctgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaattcaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccgtaaattttgttgcggtctctaaactctgttaaacgggcatagtaaaataatgtatagaaaaataatatactggtaagaaaccctaaatctgactatacacagacagtgggaaccaaccgtgctaaatctgtaatttaattattgacaaaataacaatatatgatataattatattatagtaaaagcctaacgactaaatttctagttatctatataaatggatatagtgagaactagataagaaaattaactatacttaaaaaaactaaaatattttaaaagagaggtgaaaacagttgacattagaaaagagaaaacaagaatatcttaagaagttaaagcaaattaaaaatgatgagtttgaattgctaggaggatttactaaaacaagagagaaagctttatttaaacataaagtttgtggttatgaatggtatactactccttataatttattgaagtctaaagggacaggatgtcctaaatgtcaatacagagataaatcatatactactgatgaatttaaaaagaaacttaaagataaatttggttatgaatatgagttaatagaaggacaagagtataaaaatagtagagaaaaattattgtttattcataataagtgcggtactgaatttaaaattacaagtgatagtttatttcgaagtaaagtaccttgtcataaatgttctaaagaaaatagaaaaactaaaaagaaaacaacagaacagtttaaaaatgaattgtataataaacataaagatgaatatatacttgttgaagggtcagaatataagacagctcttgaaaaggttagaataattcatacgaaatgtggatatacatgggatgttagagcctcacatattttgcatactagtaaatgtcctaattgtaatgagtctaaaggtgagagtttaattaaagacattcttgaagataataatttttcttatataagagagtatacttttgaagatttaaagaatgttaaaaaattaccttttgattttgcactattcattgataatgaattagtaggtttaattgaatatgatggttctcaacactttattccttttgaacactttggaggtaaggaaaaattaagaaaaactcaatataacgatagaaagaaaaatgagtattgtgataagaacagaattccgttaaagagaataaagtatgatttagatgaaaaagaagtaataagagaaatagaaatgtttttaaatagtatagttaaaagtaaagcagagagttattaaccaaaaatagtaactatgatatagtctaatccctaagtaaatattgagaaatcaagggtataaatgggcaagttaaaatagtaaatgatactcatcctaataaggctgtaataaaatcacgtcagttaggtcttagtgaaatgggtgtaatggaaatggttcattttgcagatatgcatagttatgctaacgcaaagtgtctgtatacattccctacaaatgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtaccgtagagggtgtggatattgattatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacaaaatggcagttaccaatttgtttgtcaaaaatgtggtaaaccactagatagatggtataacggtgagtggcattgtaagtaccctgagcgtacaaaaggtaataaaggggtacgagggtatctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataacagggttacagtggataaattaatgcagaataaaagatacgtacaagcacttaagacaaaggatataagtgtttatagtacagtagatgatgatttaaaaactttcttaaaacattggcaaaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatattttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagagctatttctaatggtgaagaaggaaaggtaaaccctaaaaaagtagcaaattcattatctaatttaagtaaaaaaggtgtagatgtatcccatattaatacaaactcatcattgtataaagagtttgttgatgataacggtgatacaataggaattacatcttttaaacgaactgaaaatgatataatattagaatcttatgcaagttcacctgattcagatggtgtaggagcaagagctattatggaattattacgtttaagtattaaagaaaataaaaatgcagttgtgtatgacatagaattacctgaagcaatagagtatttaaaaactttaggatttaaacctaataaagatggatacattttaagaaaaaaagatgtaaaacaattcttaggtgattatagtgattttatttagcactatagtcatctattctattgtatttattttatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagtaaagaggagaaagaagatagtattaaagaatttagtagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgtattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacctgaacctgaaccatctgaaccgtctgacaatcctgatgaaaatggaggatgggaaacggaaccaactgaacctgagtcaccttcagagccggacgataaagtggacgaagaggataaaaatgaagatactacagatgataaacagcccactgaacaaccggacgataacaacatagataatgaagataaaactgaagaggagtaattactcctctttttttgtttgctatattaaataagagctaaatataaaaaaattgaacattacggtggtgaaaactttgttaggaatgaatattataacgtcactatcagtagtatttacctgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttattataagttttataggtgcaatacttggaggaatttggtacaagatgatgaaaattattaaaaaaagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaagaagatgttttattacattgaagaaccgtttgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaaaaacgaacataacttacatgatattttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaggaaatgaaacgcatagaagattttattgttaatacaggtaaagataaagatgtagatagagattcatttcaaactttctgtaagaaaattgttagagatacttatatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagaattagctatgggtataagaaaccctagaactgaattatcttcttcaggatacggattatcagaagtagaaatagctatgaaagaatttattgcctacaataatacggaatcatttaatgatagatttttctcacatggtggtactactagaggtattttacagatacggtcagaccaacaacaatcacaacatgcattagagaactttaagcgtgaatggaaatctagtttatcaggtattaatggttcatggcaaattccagtggtaatggcagatgatattaaatttgtaaatatgacacctactgctaacgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattaaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgccagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagatgtagaccaacaacgaggaacatttggtagaatggttcaagaacgtttgccatctattggttctcatgctatgatgggtactacagctatggctacaggtttatacatgaagggtgcctcattaagtgaaactaatagaccgatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaagatgctcaatccggaaaactatctaaagaagagttagctaagaaagctaagaaaatggaaaaagaaggtaaaaaagaaggagaagataacgccactgattataaagaatctaaatcaggaaaaaatgaccaaaataaatcgaagactgatgataaagcagaagatacttatgatatggctcaaccactaagagatgctcatagtgctttagcaggtcttcctgcccctatatatttagctataggagctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataacagtcaatgttaatgttcaaggtggaaataatcctgaagaaactggagacattatcggaggaagaattagagaagttctagatagtaatatggatatctttgcaaatgaacataagagaagttattagtaattttgtattgacacaagagtagtatcataatatactactcttatacatataaaaaataaaaggaagtatgtgtatatgcgtagaataagaagacctaaggtaagaatagaaatcgttacagatgataatacatttacattgagatttgaagatacacgtgactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcgagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaatgccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacaaaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgatagtcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaatttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatgggaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtaaaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaataatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtacaataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggcagaggtataactttagaacaaattattaataataatataggttatgttattaatgggagcttttataaagttgatggggaatccaaagtatcattaaggaatagtattatattttttacttatgataatgatggaaattaccagtattggaatacacgaagtatagaaaagaacccgtatattaaatctatcaatgcccctgctaaacaagatgaagtaggtagaaaagatgtcatatttaatttgaatatagcaagaaagaaaaagttcttagttataactgagggtgtatttgatgctttaaccttccatgagtatggcgtagcaacattaggtaaacaagtaactgagaatcaaataaaaaaaataattgattatgttagtatagatacatcaatatatattatgttagacactgatgcattagataataatatagacttagcttataagttaaaaacacattttaataaagtttactttgtacctcatggtgatgaagatgcaaatgatatgggaacaaggaaagcttttgagttattaaaacagaaccgggtgctagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataacgagttaaacttaaatattttaattgatgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtacaaggaactgttgatggtaaacaagttgatgagaaaacagctaaacaattagatagaattggttcacgaagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtaggtaaagctaaagataaactaaatgaaaaacgagaagcttacctaaaagagaaacaagaagaattacgtcaaaaacaacaagaagaagaacaaaaagaaactgaatctgacagcaatgaaaaagtaattcagttgaagaaaaatgacgaacagtaagaaaaaaggggatacattcgaacgtaaaatagctaaagaattaactgcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataacgttcttttaaacaacagagagccacacacatggtgggagcaagtcattaatgatagtagtaaggtgaataagacaccttgcttaatatttactagaaatagagctcagagttatgttgctttaccttatgatgagaaagtatatgaagatttaagaaataatgaataccctgtcatgagaacagactttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagcaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaaggttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgctagtgagtctgttagactagataaattatctattggtgttacaatccctaacaaatttatggagttagttaaagaaggtaaacctttctatacttttgatacttacgacattaataaagtgtacggtaagtatttagatgagctaaacattgatgaatggtatgataagttactagataatgatagtatcggtaaagtaaaacatgatgctagagaagttatgacagatattgctaaaacgcaattagaatcaggctacccttatgtattctatattgataatgctaatgataatcacccattgaaaaacctaggtaaagttaaaatgagtaacttatgtacagaaatttcacaattacaagaggtatcagaaatttatccgtactcttacagtaatcagaatgttattaatagagatgttgtctgtacattaggttctcttaacttggttaatgtggttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagggaagcattagacctagtaaacagtttatatagtgctattaacttccagtctattaagacatctatgttaatggctaaagaaacaggaaaaccatttaaaggctttgagaagtccgattatgctacaggtgaatactttgtaagatatattagagaatccaatcaacctaagacagataaagctaagaaagtcttaaataaggtttatattccaacacaagatgattgggatgaattagctaaagcagtaaaagtacatggcttgtataatggttatagaaaagcagaagcacctactcaatctatatcttatgtacagaatgctacaagttctattatgccagttcctagtgctatagagaatagacaatatggagatatggagacatattacccaatgccttacctaagtcctataactcagttcttctatgaaggagaaacagcttataagattgacaataaacgtattattaatacaagcgcagttgttcagaaacatacagaccaagcagtgtctacaatactttatgtagaatcagaaatccctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcttatagtcatatttttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaatttattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatgcagacaaaacgtaattcatttactaagaaattacttaatatgattaataaacaaaaacgaacattatatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggttgccttaactagccacaatgacttgtaaagagttattacaaaaccatgtgaattgctgggaagccttaaagacttattaactacaacgtaactggaaacagtaggcgtgaatgtttaaaaataataagtatatgagttatatggtataacgaaaactttttgttatattatatagtgtaggtaatcagcatccaagcttctaagttgaaaaataagaagaaggttcaacgactatcgaaaagatatctagtaccgagaggtattagagagtaactgagtagagtaaaagatattaatctttgaagtgcatgggaattgcctacgaaatctattagaaaaatggagagtagtataatatggtaaaacgagtttggactaatgaagagaaacaagatatagtaaaatcatttcaagaaggtaaaacgtttaaagaattacaagataagtataatgcacattatttcactatcaagaaaattttagatgagtttaatattgacacaaataaaaaacgaagatggactaataagcaaaaacaagatatactaagaatgtatactaaagagtctatgactatagcagagataaaaaaggtatatacaacacacgcaagagaaataggtagaatactaaaagactttggagtagatacttcttactatcaaactagaagcgttaatagaaatataaatagaaatttctttgaagtaattgatactgaagagaaagcttatatactaggtttattaatggctgatgggtgtgttagatatagacgagaagggcaatgttacttaacactagaattgattgataaagaaatagtaaaaagagttcaaaaagaattgaattcagacagtaaaatatatgaatcacatagaaaaagagattatataaaaaacgaaaaacaaacttatacttttagtgttaccgatgaaaaactatgtaatgacttagctaaatatggtatagtacctatgaagtctaaaaaaacagaatgtttaacacaagatataccttatgatttaagaaaacattacttaagaggattatttgatggtgatggttcaatcgggtattataataatagatggtttataactttaattaataatcatcctgaatttttaaaagatgtaggtacttggattgatgatttattaggtttaaaatgtcctaaagtatctaaaactagtacctcttatagaataggttatacaggtaaaaaagctaaagaattaatgaaattactatatcaagataataatattcatataatccgaaaacaaaaacttgcagaccaggcaattcaagatatagtctaagcccactattaaattagtgttaaagtactgggaaactaggggtagtaactgaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgttgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgttagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttacaggggaaacaatactctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggagccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttggtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataggttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatctcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaatgaataaaaggagaaacgtatagtattattgctcatatcaataaacaaactggttggggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtagatttgagcattccacttatcctcctgatgaggggtttgcgtatgtagattatgtagatgtgattcttattggtgtagataatcctaggaaaagaaagattattaccttaaaagtaaatgagttcaacccggatgactacagagtaggtcataagtacaatattataaaaatactatggtttgaaaaatgggaatggttaaagccataagtaaaaggagagaaataaaatgattatagataaattaaatggagttaaattagaaataggtgggcatgtcgtatcatttagtgtaagaaagtttaatacaattaatggtgagagacaattaatagactaccatcatattaaaagaaatagacaacagtactttagaactactgaagaattttataatgaatataaagaaattaagcctgacaaaaatgaaatagatgaaatgtttgaatctctaggttatgtagatactgagttagatgatgtagtaagaaaccaggaaaaggttactgaaatattaggagttagtgaacaatatttaaatcagttatcttataaagctatagaggagtatgtagataaagtagttacacttgaaattaaagagttgaaaggagagaaatagcatgaataataactgggaaaaagaaggagttaactattgggaaaaagaaggagttaactattgggaaaacgaagactgtcctagggaatacttagagaaagcattcattgacctggtagaatatgttgaaggagttacagtaccacctaaagatgttaagcagttaagagaagataaacttagagaagatattgggttttatgagtacgtagctgataaataaattagtatctacctattgacttaggtaggtatctattatataatagtatacaaggagatgaaaatatgaaaaagttaatagtattacttacaattactatttctctattactagggggttgctctcctgataaccatgaaggtaaagtagtaggagtaggtgaatacagagaaccaactacttatataaaatcaggtagcgttactgtaccagtcattggtgaaatgaaatactatgtagatttagagacagataaaggagaagaccgtgtatatcttaataaagaggtctatcataagtttgataaaggtgatgatttctctaatgtaggtgagaaagtgtataagaatgatgaattaatatataaaggagactaactatgtatttaaatgattatgtaggtaaatttataaaggaagataactattatggatatcaatctacagacttagtatctaattatgttcaacgattaactctaggtaggtacaaaactaagttaaatgctaataaaatgaaatacgaaagattacctagttcttggaaaataattaaagccaaagatttgttaagaacagatgattatagagaaggagatatatttgtatcagaaagaatctccgtattcggttttaatggtattattgtatataaccatgattttaacaatgtaactgttattactcaaaatagagatggtaaagctactaatcctgtagaggagcatttatatccaaagaaagatattgattatattattagacctatcgagagggactacagggaatactttaaaaaatcagattcaaaagaaaaagttactctttcgaagcaagaatataaaaaattattagaggcttataataaaatgaaggaagtgtttaagtaatatgaatagtacaaaattagtagagtactttacaaataaacaaggtaaatctctaatattacctgatgaaaataaagttgagttatatagagttgatgtaacaccttatactatgagacttaatttcacttacaatacagaagttgtagctatagatattgataagttacactcagattctatagaaatgcatataccacaaggtctttatataacaactgttgttaaaattactagtacgcagagtattagttcagttcttcataaggtattagaggaatgggtaagacaagtacaaaatgatggtatattcggattcgtatgggagtaattataatgataagtatagaacatgattatacaataagaactgtagataatagaaaatatacttattatagtaaatacgaatcactagttactttgtatgaaaatattatgagtaaagattgtattgaagtaactaaatatgggaaagataaaaaagttattattgatactagacatattgtatctattgaacgatggtaaataataaggaggagtaaactattatgataaatgcagggcatgctaagtacctatcagaaatttatgaagatgatgtacattatgaaactatagatagtattgtagaagatatactagataatattaatgatggtattattgaagaagctatgaaaggtaatacaagttatcaatatgttcttagagacttaagagtagataatgaagtagaatatagagttatagaagaacttactaaccaaggatatagtgtaaaccacattagtaatgatatagagtacccttctatatctacaaataatttagcagggttagattacttaaatattaaatggtaagggagggaattaatatgataaataaatataaaaagttatgggatgaaataactcaacaaattgttaatgtagaaattattaactttaaaaatgaaacagtaacaatagaatctacagatgattcaggattatcagagataagaggttttgaagaagtagagtttatagattactatggataagatgtttaaagtatataatttataaggaggaaacatatggacttgtttgcaaaaataattattatgtctataggagttgttcccttgttaactattattgttgcacagctaattacagattaccatgataatcattaagtattatagtaataggaaggacaatatttagagtgagagtatgttgactaatgaggaagatatagaatgagaacctaaccaagtaaaactaagtacctttgttatgtactactattactactactattactactactattactactactattactactactattactactactattactactactaagtacctttgttatgtactactattactactactattactactactattactactactattactactactattactactactattactactactattactactactattactactactattactactactattactactactaagtacctttgttatgtactactaagtacctttgttatgtactactaagtacctg

The invention claimed is:

1. A bacteriophage composition substantially free of bacterial components comprising two or more obligately lytic bacteriophages, wherein at least one of the bacteriophages comprises a nucleotide sequence having at least 90% identity to any one of SEQ ID NO: 1, SEQ ID NO: 2, or SEQ ID NO: 3.

2. The bacteriophage composition of claim 1, wherein the composition's target bacteria range is broader than the range of any individual bacteriophage in the composition.

3. The bacteriophage composition of claim 1, where the composition comprises at least one bacteriophage comprising a nucleotide sequence having at least 90% identity to any one of SEQ ID NO: 1, SEQ ID NO: 2, or SEQ ID NO: 3; and at least one additional bacteriophage.

4. The composition of claim 1, wherein the composition is substantially free of bacterial endotoxin.

5. The composition of claim 1, wherein the bacterial composition is substantially free of bacterial host protein.

6. The composition of claim 1, wherein the composition further comprises a pharmaceutically acceptable excipient, diluent, or carrier, or combinations thereof.

7. The composition of claim 6, wherein the pharmaceutically acceptable carrier, diluent, excipient or combinations thereof comprises calcium salt or magnesium salt.

8. The composition of claim 1, wherein the composition is a liquid, semi-liquid, solid, frozen, or lyophilized formulation.

9. The composition of claim 1, wherein the two or more bacteriophages infect and lyse methicillin-resistant *Staphylococcus aureus* or methicillin-sensitive *Staphylococcus aureus*.

10. The composition of claim 1, wherein the composition comprises between $1 \times 10^5$ and $1 \times 10^{11}$ PFU of each bacteriophage.

11. The composition of claim 1, wherein the composition is to be administered at a dosage of $1 \times 10^9$ to $3 \times 10^{11}$ total PFU per milliliter.

12. The composition of claim 1, wherein the composition is stored at 2-8° C. or at room temperature.

13. The composition of claim 1, wherein the nucleotide sequence of at least one bacteriophage in the composition is not naturally-occurring.

14. The composition of claim 1, wherein the composition comprises two or more bacteriophages, wherein the two or more bacteriophages individually comprise a nucleotide sequence having at least 90% identity to SEQ ID NO: 1, SEQ ID NO: 2, or SEQ ID NO: 3.

15. The composition of claim 1, wherein the obligately lytic bacteriophages are capable of complementation.

16. A bacteriophage composition substantially free of bacterial components comprising one or more obligately lytic bacteriophages and a storage medium for storage at a temperature at or below 8° C., wherein the bacteriophage comprises a nucleotide sequence having at least 90% identity to any one of SEQ ID NO: 1, SEQ ID NO: 2, or SEQ ID NO: 3, wherein each individual bacteriophage is not prone to generalized transduction and does not carry an antibiotic resistance gene.

17. The bacteriophage composition of claim 16, wherein the storage medium comprises a cryoprotectant.

18. The bacteriophage composition of claim 17, wherein the cryoprotectant comprises glycerol or sucrose.

19. The bacteriophage composition of claim 18, wherein the glycerol is in a concentration of about 5% to about 30% (v/v) and the sucrose is in a concentration of about 10% (v/v).

20. The bacteriophage composition of claim 16, wherein the composition is substantially free of bacterial endotoxin.

21. The composition of claim 16, wherein the composition is substantially free of bacterial host protein.

22. The composition of claim 16, wherein the composition further comprises a pharmaceutically acceptable excipient, diluent, or carrier, or combinations thereof.

23. The composition of claim 22, wherein the pharmaceutically acceptable carrier, diluent, excipient or combinations thereof comprises calcium salt or magnesium salt.

24. The composition of claim 16, wherein the composition is a liquid, semi-liquid, solid, frozen, or lyophilized formulation.

25. The composition of claim 16, wherein the bacteriophages of the composition infect and lyse methicillin-resistant *Staphylococcus aureus* or methicillin-sensitive *Staphylococcus aureus*.

26. The composition of claim 16, wherein the composition comprises between $1 \times 10^5$ and $1 \times 10^{11}$ PFU of each bacteriophage.

27. The composition of claim 16, wherein the composition is to be administered at a dosage ranging between $1 \times 10^9$ PFU and $3 \times 10^{11}$ total PFU per milliliter.

28. The composition of claim 16, wherein the composition is stored at 2-8° C. or at room temperature.

29. The composition of claim 16, wherein the nucleotide sequence of at least one bacteriophage is not naturally-occurring.

30. The bacteriophage composition of claim 16, wherein the bacteriophage comprises a nucleotide sequence having at least 93% identity to any one of SEQ ID NO: 1, SEQ ID NO: 2, or SEQ ID NO: 3.

31. A bacteriophage composition substantially free of bacterial components comprising one or more obligately lytic bacteriophages, wherein the bacteriophage comprises a nucleotide sequence having at least 90% but not 100% identity to any one of SEQ ID NO: 1, SEQ ID NO: 2, or SEQ ID NO: 3, wherein each individual bacteriophage is not prone to generalized transduction and does not carry an antibiotic resistance gene.

32. The bacteriophage composition of claim 31, wherein the bacteriophage comprises a nucleotide sequence having at least 93% identity to any one of SEQ ID NO: 1, SEQ ID NO: 2, or SEQ ID NO: 3.

33. A bacteriophage composition substantially free of bacterial components comprising one or more non-naturally occurring, obligately lytic bacteriophages, wherein at least one of the bacteriophages comprises a nucleotide sequence having at least 90% identity to any one of SEQ ID NO: 1, SEQ ID NO: 2, or SEQ ID NO: 3; wherein each individual bacteriophage is not prone to generalized transduction and does not carry an antibiotic resistance gene.

34. The composition of claim 33, wherein the obligately lytic bacteriophages are capable of complementation.

* * * * *